United States Patent 11,446,398 (REGULATED BIOCIRCUIT SYSTEMS) - sequence listing, part 37

SEQ ID NO: 123203 - DNA, 3236 bp, Homo sapiens
  Payload ID: 4192
  Gene Symbol: CELF4
  Gene Name: CUGBP, Elav-like family member 4
  ENST ID: ENST00000590112
  CDS Start-End: 53-805
gtcagcgctgaaggcccagagcgcgctgcacgagcagaagactctgcccgggatgaaccggccgatccaggtgaagcctgcggacagcgagagccgaggagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccggtgagtgctggccccttggggcgggggcgagggcagcggcgggccgagaccccagcacccgccacgccccgccggctgtccagtctccccaagagacaggaaagcatgacccttattccgggcctcagacaaggacgcggaagcccagggatgttaaggaactggcctgaggttacccaggtggaaaatgcccgcggtggggttcacacctcattcccctgggcgagcgccgatgccgcctcctccaaagcgccccgaggagcgggcggggtgggcgcaggccagaggcaccgacagctgcgggcggaggctctggagcaggtgggtctcacgcgccgccccggccgcagggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcagtaagtggcagcgcgcacgggcagcggttctcaagctcactcccctgggagcctcagagagcgggacatgaaaccgaaaatactactctatcccttgccctctccctccagagtgaggaggggccgggaatgaacccatgaacctggggggtttaacttcagaagggtttgaaagaaggctggcccagttggggtggctgccaggaggaggtgggctgctgtcttagttctaaggggcagagctgagagaggccccacagaaaagtgggttaccctgagccttttcctctcagccagatcaacgttgaaccccaggaagcacagatgagagggtgaggttcaggtcattggttgcaaaccacccctactccatggaacggtgacttcaggccttctggtctctcctggcagggctcctgtgaggtgccctaaagccctacacacccacacttctgatatcccctcaggcctctggcccacctacttctttcttccacatgggggcccactctgtcagcctctcccggagctgcctgcagactggtaaccacagctcccatgtgggtggcactgaggcaggccacggttctgggtctgaaaatgcaagcttacctcacttctgcagtactgtccgccttggccacattccgcagcctcccctgtccgcactcacctttgtgacaacactaggggtgcctggggttctattcataattctcctgtcacttctaccaacagactccaaattaaaaccattctggacagaaacctgtgctaagtgagttctgcagaggctcatccagcatgtctctagtgctttggatgtcacttccccacgaatgacaggctgtacacagggctgactagcacccacagagccagtctcctcctctgcccctagcaacaactttggagttccaaagaccctagcattacttttaaatacagtcatctctcagggtggtggactctaatagctgttgaggtacagggcaagaatgggagaggcatcagggctttctggagtggtagttgggagcttctggggctcagagcctgggagattggtctccaggagctgaggcccctgtcggggagggatgccccctggaagcacgtgatattttttccactccctctgccccagctgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatg

SEQ ID NO: 123204 - DNA, 1836 bp, Homo sapiens
  Payload ID: 4192
  Gene Symbol: CELF4
  Gene Name: CUGBP, Elav-like family member 4
  ENST ID: ENST00000601019
  CDS Start-End: 108-1562
gagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcagctgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaag

SEQ ID NO: 123205 - DNA, 989 bp, Homo sapiens
  Payload ID: 4192
  Gene Symbol: CELF4
  Gene Name: CUGBP, Elav-like family member 4
  ENST ID: ENST00000601392
  CDS Start-End: 108-989
gagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatg

SEQ ID NO: 123206 - DNA, 532 bp, Homo sapiens
  Payload ID: 4192
  Gene Symbol: CELF4
  Gene Name: CUGBP, Elav-like family member 4
  ENST ID: ENST00000587911
  CDS Start-End: 1-209
ctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggccagtcaaatccaccacagtctcgcgctgagctaggaataaagttcacgtaatcacatgagagtggagaaaagtcccccatccggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttg

SEQ ID NO: 123207 - DNA, 1906 bp, Homo sapiens
  Payload ID: 4192
  Gene Symbol: CELF4
  Gene Name: CUGBP, Elav-like family member 4
  ENST ID: ENST00000603232
  CDS Start-End: 187-1644
cgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcaatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaag

SEQ ID NO: 123208 - DNA, 1854 bp, Homo sapiens
  Payload ID: 4193
  Gene Symbol: CELF5
  Gene Name: CUGBP, Elav-like family member 5
  Uniprot ID: Q8N6W0
  ENST ID: ENST00000292672
  CDS Start-End: 38-1495
ccgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaa

SEQ ID NO: 123209 - DNA, 1591 bp, Homo sapiens
  Payload ID: 4193
  Gene Symbol: CELF5
  Gene Name: CUGBP, Elav-like family member 5
  ENST ID: ENST00000334293
  CDS Start-End: 218-1180
attcagcctccccaggccccgtcggggaagtttgcacctgcggactccattgctttggttattttcacaaagccaggccggcggggcaggtccggccgcgggggacacggatgcccaggaccccaggctaatcggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggag

SEQ ID NO: 123210 - DNA, 4268 bp, Homo sapiens
  Payload ID: 4193
  Gene Symbol: CELF5
  Gene Name: CUGBP, Elav-like family member 5
  Uniprot ID: Q8N6W0
  ENST ID: ENST00000541430
  CDS Start-End: 37-1266
cgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgagccgccaggcggccccacccccgcccaagccccccgtcttgtctgaaaccccctcccgcggcccacttcatgctccaaaccctccccaggtggggtgatgcttcaagaggctacaagaaacctccgggttgggttggcggggacagagctggatgtagacacccccgatccccctgtggttggggctggagcagagggtgggaatggggtagggactgaggtgagccagggcccagtgaggtcggttagggaatccttcccggagaaggctttgagggctgaatagaagttcacctgagaggccaggtttgctctgggggtgggggtgcggtggggagggggttctgtcctgtcctatgagtctgttttccctgctgaaaacccaacaccagacggaaatgccaagtgcccaccccagaccccaaaccctaaggttggaccccaactcggaaccaggagtggagcgtggaaggtggggacagtgctcagggcccagtccagttggcactgacagcttccagtgtccccgctccatttccactagttcccctgggacaagcggcccctcactgggtgtcattcctacccaatgagttgatggaaaagtgggattcgtgccccacccaccatcatgcaagaaaaacaagcaaaacgaaacccagactgtagtttgccatcagggcaaaccactttctcaacatttttttgtggggggatgaacagtaaaccttgtggggccactgtggaaacttaaccgtgggtctcaaaccttgatgagcctcatctgtaaaatgggttcaagaaagtcatctccccagagacggcggaaacggtccacctagggaacagagtggggcatcttttcgcagccgagcccagaacccatcacctaaagagttctggatgattcgttttgattttttttttttttaaatcaccatcgctgtcgtcatcagagtctcgcctagggcctggcacagagtagacgctcagttagaagctgtctggccttttcaccttctcccgggtcagcacacacagatttgggagtatttacctgcacagaacgcaccttcaggaactgccaaccagaagcaaaatccaaagctgctctctgcgatcccttcacttttaactctcagtctgcactttttttttttaactgagcatctattatgtgctaggcactgttccagtgctcggggacgcagctgtgaatgaacagaaacgggggatggaggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaag

SEQ ID NO: 123211 - DNA, 3115 bp, Homo sapiens
  Payload ID: 4193
  Gene Symbol: CELF5
  Gene Name: CUGBP, Elav-like family member 5
  ENST ID: ENST00000588350
  CDS Start-End: 43-930
agtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaaaaaaaaaaaaccaagcatttccttttctttctaccaaaatgtgttgactgacccggagggggggcggtagggtgggggaaaccacacagaaaaaaaaaaaaaaaaaaaaaagaaaagaaaaaagaaaaaaaaatagaaaagaaaaaaaaaaatcttctgaaccaacttgtttcgatattccagagtttgataattgtttcgagactctcctctagcgtgcctgtgttccgtgtgtccccgtgtgcaagcgtgtgccatgccaatctgcctcgagggggcctcacccgtgtccgcggcgcccgccgaggcccccgagggcctgcttgggagtgtgtgccggtgtgcagttgtacgtgtctttctggtccatgtttactggctgtaaataccatttttatactccacatcgcagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaa

SEQ ID NO: 123212 - DNA, 3345 bp, Homo sapiens
  Payload ID: 4194
  Gene Symbol: CELF6
  Gene Name: CUGBP, Elav-like family member 6
  Uniprot ID: Q96J87
  ENST ID: ENST00000287202
  CDS Start-End: 256-1701
gcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 123213 - DNA, 1741 bp, Homo sapiens
  Payload ID: 4194
  Gene Symbol: CELF6
  Gene Name: CUGBP, Elav-like family member 6
  Uniprot ID: Q96J87
  ENST ID: ENST00000395258
  CDS Start-End: 215-1321
cgggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggaggctcctgaacaggatgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaaca

SEQ ID NO: 123214 - DNA, 2497 bp, Homo sapiens
  Payload ID: 4194
  Gene Symbol: CELF6
  Gene Name: CUGBP, Elav-like family member 6
  ENST ID: ENST00000437872
  CDS Start-End: 1-402
agcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcct

SEQ ID NO: 123215 - DNA, 1676 bp, Homo sapiens
  Payload ID: 4194
  Gene Symbol: CELF6
  Gene Name: CUGBP, Elav-like family member 6
  Uniprot ID: Q96J87
  ENST ID: ENST00000543764
  CDS Start-End: 176-1210
atcagtaccccttcctccatgaacgggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagccaactccccgcctggcagcggccctggcaccctcccaggtcttccggcgcccatcggggtcaatggattcggccctctgaccccccagaccaatggccagccgggctccgacacgctctacaataacgggctctccccttatccagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagct

SEQ ID NO: 123216 - DNA, 1496 bp, Homo sapiens
  Payload ID: 4194
  Gene Symbol: CELF6
  Gene Name: CUGBP, Elav-like family member 6
  Uniprot ID: Q96J87
  ENST ID: ENST00000567083
  CDS Start-End: 9-1373
gcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggaccc

SEQ ID NO: 123217 - DNA, 3064 bp, Homo sapiens
  Payload ID: 4195
  Gene Symbol: CUL1
  Gene Name: cullin 1
  Uniprot ID: Q13616
  ENST ID: ENST00000325222
  CDS Start-End: 280-2610
agccccggtagctgagggacgcagctagaccttggcgggacggggctttcgccggggcccaggcccagggaccaggcggaggcgtcgcgggagcctttggggcaccacagagatgcgggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaaggatttctgtacaa

SEQ ID NO: 123218 - DNA, 2857 bp, Homo sapiens
  Payload ID: 4195
  Gene Symbol: CUL1
  Gene Name: cullin 1
  Uniprot ID: Q13616
  ENST ID: ENST00000409469
  CDS Start-End: 527-2857
actattttatatcacgactcatgccatccgtatgtgtaatcaaagccttctaagtcttgatatgtccttacaaagacgaaggatagagtgaatgtcaaaatttgccaaacaggagttactgaaagtctgaaggggaaagcctagttaggttttatcttagaagtgatttttaaaacgaaacacgcagataagctcgagctttctggagccgattcctaaggccttgcaggtggtaagggggtcgagaattggctgaggttcctcggaagtccgcgccgattcggagggccacctctgactttctgatctggggtgcaacccccagtccctgtcccggtcgacaaaggtgtggagtcaggttccaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaa

SEQ ID NO: 123219 - DNA, 3054 bp, Homo sapiens
  Payload ID: 4195
  Gene Symbol: CUL1
  Gene Name: cullin 1
  Uniprot ID: Q13616
  ENST ID: ENST00000602748
  CDS Start-End: 281-2611
gcgcctcgggctggcggggcgatggcgacgacggtttcccggctcccccgccccggacgccgatggcggtgcgttccggccctcccccaacagcttctcccccgcggtcgccggagccggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagaccaagactcccatcagctggtctcggatttacatcggaactgctcaggattgatacatttcaagtctgtaaatacggacaccaacgccatttaccctaatttaagaacagcggggactgaccctccgtgccgagggctgcatgctaccgcactaagtcaatacatgggctccccgattcgcagctgtcgtcttggcagcacttgtcacgttggcagcactttgagagcaagtctgagtggacccacatgtaacctgctatgaaaaccatttgtatagtgtgtttcattttttaatgtgtgaaaataaagaaaattaaagga

SEQ ID NO: 123220 - DNA, 2508 bp, Homo sapiens
  Payload ID: 4195
  Gene Symbol: CUL1
  Gene Name: cullin 1
  ENST ID: ENST00000617797
  CDS Start-End: 125-2383
ggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacactcatgtttataactactgtactagtgttcaccagtttgttggcctggaattatataaacgacttaaggaatttttgaagaattacttgacaaatcttcttaaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcgcttgcattggtgacttggagagactgtctgttcaggccactgaataaacaggtaacaaatgctgttttaaagctgattgaaaaggaaaggaatggtgaaaccatcaatacaagattgattagtggagttgtacagtcttacgtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaagatttgggacgcatgtataatcttgtatctagaatccaggatggcctaggagaattgaaaaaactgttggagacacacattcataatcagggtcttgcagccattgaaaagtgtggagaagctgctttaaatgaccccaaaatgtatgtacagacagtgcttgatgttcataaaaaatacaatgccctggtaatgtctgcattcaacaatgacgctggctttgtggctgctcttgataaggcttgtggtcgcttcataaacaacaacgcggttaccaagatggcccaatcatccagtaaatcccctgagttgctggctcgatactgtgactccttgttgaagaaaagttccaagaacccagaggaggcagaactagaagacacactcaatcaagtgatggttgtcttcaagtacatagaagacaaagacgtatttcagaagttctatgcgaagatgctcgccaagaggctcgtccaccagaacagtgcaagtgacgatgccgaagccagcatgatctccaagttaaagcaagcttgcgggttcgagtacacctctaaacttcagcgcatgtttcaagacattggcgtgagcaaagatctgaacgagcaattcaaaaagcacttgacaaactcagaacccctagacttggatttcagcattcaagtgctgagctccgggtcctggcccttccagcagtcttgtacatttgccttgccgtcagagttggaacgtagttatcagcgattcacagctttctacgccagccgccacagtggccgaaaattgacgtggttatatcagttgtctaaaggagaattggtaactaactgcttcaaaaacagatatactttgcaggcgtcgacattccagatggctatcctgcttcagtacaacacggaagatgcctacactgtgcagcagctgaccgacagcactcaaattaaaatggacattttggcgcaagttttacagattttattaaagtcgaagctattggtcttggaagatgaaaatgcaaatgttgatgaggtggaattgaagccagataccttaataaaattatatcttggttataaaaataagaaattaagggttaacatcaatgtgccaatgaaaaccgaacagaagcaggaacaagaaaccacacacaaaaacatcgaggaagaccgcaaactactgattcaggcggccatcgtgagaatcatgaagatgaggaaggttctgaaacaccagcagttacttggcgaggtcctcactcagctgtcctccaggttcaaacctcgagtccctgtgatcaagaaatgcattgacattctaattgagaaagaatatttggagcgagtggatggtgaaaaggacacctacagttacttggcttaacccttctggaagggtctgactgtgtgacccgcagcaaatagttcatgttggaaagaatgaaaacaactcaagttcatagcagccagcctgccgccattggacctcccttttaaaaactgagacca

SEQ ID NO: 123221 - DNA, 3903 bp, Homo sapiens
  Payload ID: 4196
  Gene Symbol: CUL2
  Gene Name: cullin 2
  ENST ID: ENST00000374746
  CDS Start-End: 23-2143
atttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 123222 - DNA, 4312 bp, Homo sapiens
  Payload ID: 4196
  Gene Symbol: CUL2
  Gene Name: cullin 2
  Uniprot ID: Q13617
  ENST ID: ENST00000374748
  CDS Start-End: 315-2552
cggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagagcgctgacccgtaagccctgccaccccctggactggatcccgggcctccccaacccgatcttggccgcctctcccgcggccccattttccttcgaaggagggaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 123223 - DNA, 4208 bp, Homo sapiens
  Payload ID: 4196
  Gene Symbol: CUL2
  Gene Name: cullin 2
  Uniprot ID: Q13617
  ENST ID: ENST00000374749
  CDS Start-End: 211-2448
ggcggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 123224 - DNA, 4233 bp, Homo sapiens
  Payload ID: 4196
  Gene Symbol: CUL2
  Gene Name: cullin 2
  Uniprot ID: Q13617
  ENST ID: ENST00000374751
  CDS Start-End: 236-2473
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 123225 - DNA, 4440 bp, Homo sapiens
  Payload ID: 4196
  Gene Symbol: CUL2
  Gene Name: cullin 2
  ENST ID: ENST00000374754
  CDS Start-End: 487-759
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacaggtgagtgtcggcgcgcgggctccccgggcttcgctccccaccccccgcgtctccggggccggtggcggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataaggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattga

SEQ ID NO: 123226 - DNA, 2376 bp, Homo sapiens
  Payload ID: 4196
  Gene Symbol: CUL2
  Gene Name: cullin 2
  Uniprot ID: Q13617
  ENST ID: ENST00000421317
  CDS Start-End: 63-2357
atgttgcagttgagcccaaactgaatgctgtctgtagaaggaaacaacaaactttgtactttatgtacagagtaacatggtcaactttttggcttagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgt

SEQ ID NO: 123227 - DNA, 4271 bp, Homo sapiens
  Payload ID: 4196
  Gene Symbol: CUL2
  Gene Name: cullin 2
  ENST ID: ENST00000537177
  CDS Start-End: 236-2512
gtcacagtagggagtaccaggaggagaggaagcttgggtgccatgttgcagttgagcccaaactgaatgctgtctgtagaaggaaacaacaaactttgtactttatgtacagagtaacatggtcaactttttggcttaggtaggttatttttgtgtctttgataagggcaagatctgagattctgatcttgaagtcaagaactttgttttgtccactgtatcctcagagcttggaatggtgcctggcaaggaatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattg

SEQ ID NO: 123228 - DNA, 4115 bp, Homo sapiens
  Payload ID: 4196
  Gene Symbol: CUL2
  Gene Name: cullin 2
  ENST ID: ENST00000626172
  CDS Start-End: 236-2356
attgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcgttttcattaaatatgaactttagcagtaaaagaacaaaatttaaaattactacatcaatgcagaaagacacaccacaagtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatcatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattg

SEQ ID NO: 123229 - DNA, 6741 bp, Homo sapiens
  Payload ID: 4197
  Gene Symbol: CUL3
  Gene Name: cullin 3
  Uniprot ID: Q13618
  ENST ID: ENST00000264414
  CDS Start-End: 340-2646
cctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccgatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaa

SEQ ID NO: 123230 - DNA, 6592 bp, Homo sapiens
  Payload ID: 4197
  Gene Symbol: CUL3
  Gene Name: cullin 3
  Uniprot ID: Q13618
  ENST ID: ENST00000344951
  CDS Start-End: 389-2497
tctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacatggaaagctaagggtttcaccttctgattttgacataattggaaattttctataatggtaagatgtttataggaaagtaatggtagttcatgtttgagaatttttttattgctttcatttcccagttaaatgatatttaacacctgggaaaacaggacagctcagattgtcgagttagtaaacatgagcgatgtaaaaactttatttgaaatctcctaagtgagacattaaacattttagtgctagtttaagccattaaaagtaaagtttaagtttacgtcattgtctcaagtgtggctgtaaaaatcagatctagagtttagagacatacttgttaactttggagcacaggtttgatatttatgcttctaaatacattaaaacatttctgaattgcagttgaatggttggagattgctggcgatgtgatgctgcactgaaaaaactggtcacacaaaatgtttatatgtttgactgcataagtattattttaggtcataaaggttataacaaaatacatttaacattgctttctttttagcaagaggtcacagatgctattttttctcagtttttaatgctttaatttgaaagaaaaatgcatcctaaccattccatcctgttggtgcagagaaattttggtgatttattagaagacttttaaggagggtggatacatagtttttcaactgcaaaaatcatgtcatctcttcagtaactgttaaagtgtaattctctgccttcattatcaagtccaggacagtgtttattttgaatcgttaacattatttaaagactgaaaattcattgcaattagggaacgcacagcctcacaaaaagtggttgtgattgcaaggattctttatgtcagtgaacttaaaaagggaatgggggaagagatgcatgcctttctaaaggtatgctagagtcacctgtgtagcattgtaattatgtactatcaaacccccaagatgctgatgataggccttctctgtaagaatccttctcatagtgaagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgatacagagattggccattacgccagctctcaggagaaaaacaactaggatgtcttgaaacccgtgcatttaattttagaaatggcaaatttgtaagcgtgtcatttaagtaatttgatgctcagttttagggtctaagttgacctcgagtgagccatgcaaaaatagctttaaaattatacatgagcagctcaaagtaaacgtgtattttttagtaacaatgaaattgtcaaatttcaagattttaataacaggacagttcaactaataaactttattgcatacaagatttattgcaatgtgggaaaattaaaattctcagtctcagaa

SEQ ID NO: 123231 - DNA, 3147 bp, Homo sapiens
  Payload ID: 4197
  Gene Symbol: CUL3
  Gene Name: cullin 3
  Uniprot ID: Q13618
  ENST ID: ENST00000409777
  CDS Start-End: 607-2841
aggacagagttctcagggtgaaaatgatttaaatggctctggaaaagtagtatacaagagatgtaggggaataatgttttctaaaagaaagctacgttatactgaggtgcatttatcatagtgttattcttaaggtgcctttgttttagctcatatctgtatatttgctaagcttgaaaaagctatatttctttctgacatttatttgatgactgtcgatgagcgttcaagagattctatcattgggcactttcctttgttgatgcatgagggattatactgtgctctgggctgtgttaaatctactgacgttctcatttaatcttcatgacagccctttgagatagatgctgttattgaacccaggacttaattttctcaaggtcacatggcttgtgagtaacaaagctgtggcacaaacctaaggctgtctgacagcaaaacccatgttctctaccagtatactaactatgtttaccaagataatcagtgactgtgatgttactttaccatattagcacaatggaatgtgacattagtccactgatttggactaggttttgggatatataagttctaatcccagctctatgattttggatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatac

SEQ ID NO: 123232 - DNA, 2701 bp, Homo sapiens
  Payload ID: 4197
  Gene Symbol: CUL3
  Gene Name: cullin 3
  Uniprot ID: Q13618
  ENST ID: ENST00000409096
  CDS Start-End: 144-2378
gtagaaaattattcacagaggactaaagacttcttgtcctttgtatgtagtagatgttaagaattcacttcttttcatttagttttaatttgtctcatgatgtagttctctcagtaatcacagaaccttcaagatgtatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgccagatgttaatgattttaggtctcgaaggaagatcagtctatgaagaagattttgaggctccttttttggaaatgtctgcagaattttttcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaa

SEQ ID NO: 123233 - DNA, 688 bp, Homo sapiens
  Payload ID: 4197
  Gene Symbol: CUL3
  Gene Name: cullin 3
  ENST ID: ENST00000454323
  CDS Start-End: 1-132
cacatattgcaagtttccactttccagatgaccatattaatgctctttaataatagagaaaaatacacatttgagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttc

SEQ ID NO: 123234 - DNA, 576 bp, Homo sapiens
  Payload ID: 4197
  Gene Symbol: CUL3
  Gene Name: cullin 3
  ENST ID: ENST00000436172
  CDS Start-End: 1-576
agtagagagtgacaagagccaaggacagagttctcagggtgaaaatgatttaaatggctctggaaaagtagtatacaagagatgtaggggaataatgttttctaaaagaaagctacgttatactgagatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagaga

SEQ ID NO: 123235 - DNA, 546 bp, Homo sapiens
  Payload ID: 4197
  Gene Symbol: CUL3
  Gene Name: cullin 3
  ENST ID: ENST00000451538
  CDS Start-End: 1-334
gctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatc

SEQ ID NO: 123236 - DNA, 1426 bp, Homo sapiens
  Payload ID: 4197
  Gene Symbol: CUL3
  Gene Name: cullin 3
  ENST ID: ENST00000617432
  CDS Start-End: 87-1115
aaagggagtcaaagggctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaacatgatatctaagttaaagactgaatgtggatgtcagttcacgtcaaaactggaaggaatgtttagggatatgagcatctcaaacacaacgatggatgaattcaggcaacatctacaggcaactggtgtatctttaggtggtgttgatcttacagtccgggtgctcacgacaggatattggcccactcagtcagccacaccaaagtgcaacatcccaccagcaccaagacatgcttttgagatattcagaaggttctacttagccaaacacagtggtcgacagctcacactccagcatcatatgggttctgcagatctcaatgccacattttatggaccagttaaaaaggaagatggatctgaagttggtgttggaggtgcacaagtaactggctctaatacacggaagcacatattgcaagtttccactttccagatgaccatattaatgctctttaataatagagaaaaatacacatttgaggaaattcagcaagagacagatatccctgaaagagagcttgttagagccctacagtccctcgcctgtggtaaaccaacacagcgggttcttacaaaagaacccaaatcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctc

SEQ ID NO: 123237 - DNA, 587 bp, Homo sapiens
  Payload ID: 4197
  Gene Symbol: CUL3
  Gene Name: cullin 3
  ENST ID: ENST00000432260
  CDS Start-End: 1-168
gaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggaataatacataagtgatgttgtgtcctcagtgcatcacatcaggaggcacttgatgtcagtttatcccattattggtgatgttaactttgatcattggtgtccgccagatttctccactgtaaaggtgcgagaagatgtactaaattcattgaataacaactttcttcaaacgctaaatcaagcttggaatgatcatcaaacagctatggtgatgattagagacatactaatgtacatggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacagaggcgcaataagaaatgcttgcca

SEQ ID NO: 123238 - DNA, 3705 bp, Homo sapiens
  Payload ID: 4198
  Gene Symbol: CUL4A
  Gene Name: cullin 4A
  ENST ID: ENST00000326335
  CDS Start-End: 212-2215
acttccggccctcggtccgtctgggtcctggcgcccccggccccgccgcgggtgcgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgtcctgtttcttactgtctatacagggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgc

SEQ ID NO: 123239 - DNA, 2364 bp, Homo sapiens
  Payload ID: 4198
  Gene Symbol: CUL4A
  Gene Name: cullin 4A
  Uniprot ID: Q13619
  ENST ID: ENST00000375440
  CDS Start-End: 85-2364
ggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctga

SEQ ID NO: 123240 - DNA, 4037 bp, Homo sapiens
  Payload ID: 4198
  Gene Symbol: CUL4A
  Gene Name: cullin 4A
  Uniprot ID: Q13619
  ENST ID: ENST00000375441
  CDS Start-End: 568-2547
attcatcccgcatcctgctgggaaacagcgtccatccgacacagcaccgcccacagcgggccctcggcgtggcccgcaggcccttcggaccgcctgggagcgcggccacacgtgccagcaagtgagggcagcgacctgggaccgccgcgtctacttacaccgcgacgactccgcgatccacggacaccgcccggcccccacggcggccctgcaggggagaactcgggccgccttcccgagtcccggccgccgctgttcggctcgcgcggctgcccgccggggacccgaacggaagaagggtggcgaggcgggaaaggaaaaggcctgagggtccaaggcaggaggggacacacggaacacgccgagggccaaccacgccgccgcgcgctccccggctaggacccacctgctgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgc

SEQ ID NO: 123241 - DNA, 3724 bp, Homo sapiens
  Payload ID: 4198
  Gene Symbol: CUL4A
  Gene Name: cullin 4A
  Uniprot ID: Q13619
  ENST ID: ENST00000451881
  CDS Start-End: 250-2229
cctggggaccggctcggcgacgcgctcgggctgagggggcccggggtctttctgccggggccccgtcctctcagccgggacgccagcggctctgattacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgcaaatg

SEQ ID NO: 123242 - DNA, 1111 bp, Homo sapiens
  Payload ID: 4198
  Gene Symbol: CUL4A
  Gene Name: cullin 4A
  ENST ID: ENST00000488558
  CDS Start-End: 29-553
ggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgcctt

SEQ ID NO: 123243 - DNA, 5666 bp, Homo sapiens
  Payload ID: 4198
  Gene Symbol: CUL4A
  Gene Name: cullin 4A
  Uniprot ID: Q13619
  ENST ID: ENST00000617546
  CDS Start-End: 161-2140
gtcctctcagccgggacgccagcggctctgattacagacctcggctgcccgacaactacacgcaggacacgtggcggaagctgcacgaggcggtgcgggccgtgcagagcagcacctccatcaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgcaaatgacacattcttcataactctttagcagctttgactactagtgcactagacagaagtcagagcagggagcacctgtcccctctcaagtgattattctttcctggccacctctaccacaaaataccagtggggccaggtagtgacaagtgggtcttttttacttggacgattcgttgtgctgtgcctttgtttcatttgagcacagtggctcacgcctgtagtcccagctatgggagggcaaggtgggaggatcgtttgagcctgagttccagaccatcctgagcaccatagggagatcctgtttccattttagtttatttatttttaattgaggtggagtcttgctctgttgcccaagctggagtgcagtggtgcaatctcagctcactgcaccctccgcctcctgggttcaagcagttctcccacctcagtctcccaagtagctgggattacaggcacccgccatcatgcccagctaatatttgtatttttgtagagacggggtttcactatgttggccagactggtcttgaactcctaacctcaggtgatctgcccgccttggcctcccaaagtgctgggattacaggcgtgagccaccatgcccggcctgcctgtttctgttttataaaagaaaggaaaatctatttatatctattctcttatttagcaatatttaatgttttattgttaaaggtcagtgtggtaaaacaaatagtatagaagaaatcattgaaaaagaaacagcacttagacagaaatgctgtaaaagtggaaaggagaaggtgaaattacttgcaggttagatggttgcatacccaggtcatctaaggagcaaatgaaaatctgtgactgaagaaagaattcaccaagttaaccagacacaaaattaacaaaaacatcagtagctttcctataaatataggctataatggagggtcattttttatttttatttagagacagggtcttaactgtcacctggactggagtgcagtggcatgatcatgtttcacggcagcctctaccttctgggctcaagcgatcctctcttctcagccacctgagtagctgggcctacaggtgtacatcaccacgcccagataatttttattgtattttttatagaggcagtgtcttgctatgttgccaaggctgttcttgtactcctggcctcaagcgaacctcctacctcagcctccccaaatgctgggattacaggcatgagacactgcacctgaccagaagtcattttttcaatagcaacccccaaaaaagataaaatacctagtaacaaatagggaaacacctatgtgaaaggtattataacattactaaggaacacaggccctgaataagtgaaagttctgttgattctcacattttgctatacagtatcttaagatgtaaaaccttcctttaaaacacaagcggattctaaagttaaaacagaaaagcaaatatgccagactagtcaaattgttttaaattctgctgtttttagaacattgtaattgaaacagcatgatgctggccctttaaaaagattcctggaacaagaaagtccacaaataagccaaatacacaggaactcggcgtggcacaaaggggccgtgtgtgatcaggaactggaactttgcaacaactacccatgctcagaagtttgggccaccttgaaaagagaaaagttggattagactcctttttatactaagggaagttccaagtggtcaagtatttacgtgtaaaaaaatacatatatatgaaaccataatcataagatactttttttgtaaattgactattattgtataaatttatagagtataaagtgatcttataaattatgcatacattgtggactagtcaagctagttacatccatcacctcaaatacttaacatttttgtagtgagaacatctgaaatttactcttagcaattttgaaatgtacaatactcaatttttgactgtattcaccatgctgtacaatagaactcagaaaaagaaaaatatagtcctcctttctaaga

SEQ ID NO: 123244 - DNA, 3109 bp, Homo sapiens
  Payload ID: 4199
  Gene Symbol: CUL4B
  Gene Name: cullin 4B
  ENST ID: ENST00000336592
  CDS Start-End: 42-2744
ctcaagtcctgcggacctgggggcttcgggatctgggcgctatgaaaagtgtctgcccagtcacttccggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgc

SEQ ID NO: 123245 - DNA, 4902 bp, Homo sapiens
  Payload ID: 4199
  Gene Symbol: CUL4B
  Gene Name: cullin 4B
  Uniprot ID: Q13620
  ENST ID: ENST00000371322
  CDS Start-End: 63-2750
cgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtt

SEQ ID NO: 123246 - DNA, 846 bp, Homo sapiens
  Payload ID: 4199
  Gene Symbol: CUL4B
  Gene Name: cullin 4B
  ENST ID: ENST00000371323
  CDS Start-End: 144-846
cttttttggtggagggttcattttccgggggtggttaggatccttgtgctgaagcatacaccgggtgtttctgtgcagtattttgaggtctttttcaacctattgtatttaatctgttattccttataacactgacaatcggtatgattgatccggattttgcagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattactt

SEQ ID NO: 123247 - DNA, 3264 bp, Homo sapiens
  Payload ID: 4199
  Gene Symbol: CUL4B
  Gene Name: cullin 4B
  Uniprot ID: Q13620
  ENST ID: ENST00000404115
  CDS Start-End: 403-3144
agttcagtttagaaactgccagtcttggtatagaacaacctaggcttatctgtttaagtcccataggtagtattattagagaataacccaggctttgggaactgtataactctgagatcgtttgaaattttcgttttgtttttcttttggctccaaccaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaa

SEQ ID NO: 123248 - DNA, 6351 bp, Homo sapiens
  Payload ID: 4200
  Gene Symbol: CUL5
  Gene Name: cullin 5
  Uniprot ID: Q93034
  ENST ID: ENST00000393094
  CDS Start-End: 617-2959
agctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggagaagagtgaggaagctcctggtgcttgggacgaggtcagcgctgtcggcgcgctgctccagcgcccaccacaccctggtgcgggccgacgggccctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaagcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctcaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattggaattttgtttaaaattttacactttaaggtagcaaatgtcaattattagaccgagcatattgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttcttttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatcca

SEQ ID NO: 123249 - DNA, 388 bp, Homo sapiens
  Payload ID: 4200
  Gene Symbol: CUL5
  Gene Name: cullin 5
  ENST ID: ENST00000532782
  CDS Start-End: 1-388
ggatgtgcatgcagtctgtctttgggatgataaaggcccagcaaaaattcatcaggctttaaaagaagatattcttgagtttattaagcaagcacaggcacttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatat

SEQ ID NO: 123250 - DNA, 3596 bp, Homo sapiens
  Payload ID: 4200
  Gene Symbol: CUL5
  Gene Name: cullin 5
  Uniprot ID: Q93034
  ENST ID: ENST00000531427
  CDS Start-End: 90-2432
ccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaagcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttcttttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaaa

SEQ ID NO: 123251 - DNA, 1109 bp, Homo sapiens
  Payload ID: 4200
  Gene Symbol: CUL5
  Gene Name: cullin 5
  ENST ID: ENST00000532064
  CDS Start-End: 430-573
cgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggagaagagtgaggaagctcctggtgcttgggacgaggtcagcgctgtcggcgcgctgctccagcgcccaccacaccctggtgcgggccgacgggccctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttccgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagca

SEQ ID NO: 123252 - DNA, 5254 bp, Homo sapiens
  Payload ID: 4201
  Gene Symbol: CUL7
  Gene Name: cullin 7
  Uniprot ID: Q14999
  ENST ID: ENST00000265348
  CDS Start-End: 87-5183
gtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattata

SEQ ID NO: 123253 - DNA, 5504 bp, Homo sapiens
  Payload ID: 4201
  Gene Symbol: CUL7
  Gene Name: cullin 7
  Uniprot ID: Q14999
  ENST ID: ENST00000535468
  CDS Start-End: 88-5436
aggaggtgctgcgtcgccaaggtggcatcctcggctccgccccggcgctctcccagggcccctagctttccgctgggtcgggcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgatt

SEQ ID NO: 123254 - DNA, 7780 bp, Homo sapiens
  Payload ID: 4202
  Gene Symbol: CUL9
  Gene Name: cullin 9
  Uniprot ID: Q8IWT3
  ENST ID: ENST00000252050
  CDS Start-End: 85-7638
agctctgaggaggcggggccaggacggcgggaccggccgctgggtcccagcgagggctgagccgggcggtgggaggaggtcaggatggtgggggaacggcatgctggggacctcatggtgcccttagggcctcggctgcaggcatatcctgaagaactcattcgacagaggcctgggcatgacgggcatcctgaatacctgatccgatggagtgtcctgaagtgtggggaagtgggcaaagtgggtgtggaagaaggcaaagcagagcacatcctcatgtggctgtcggctcctgaggtctacgccaactgccctgggctgttaggtgagcgggcactatctaagggacttcagcacgaaccagctggggtttcaggaagctttcctcgagatccaggaggcctggatgaagtggcaatgggagagatggaggctgatgttcaggcgctggtacgcagggcggccaggcagctggcagaaagtgggaccccaagcctcacggccgctgtgcttcacaccatccacgtgctcagtgcctacgccagcatcgggcccctcactggtgtcttcagggagacaggagccctggacctgctcatgcacatgttatgcaatcctgagcctcagatccgccggagtgcaggcaaaatgctgcaggctctggcagcccacgatgctgggagtcgggctcacgtccttctatcactgagccagcaagatggcatcgagcagcacatggattttgacagtcgctatacattgctggagctgtttgcagaaaccacatcctctgaagaacactgcatggcctttgagggcattcatctgcctcagatcccaggaaagctgcttttctccttggtgaagcgctacctttgtgtcacgtccctcctggatcagctgaatagcagtccagagctgggagctggagaccaaagctccccatgtgccacaagagagaaaagccggggacagcgggaactggagttcagcatggctgtgggcaacctcatctctgagcttgtgcggagcatgggctgggcccggaacctcagcgaacagggcatgtcacctccccggccaacccggtccatctttcagccctacatttcaggccccagccttttactccccaccattgtcaccacccccagaagacaagggtgggtcttccgccagcgctctgaattctccagccgtagtggctatggagaatatgtgcagcagacactgcagccagggatgcgagtgcggatgctggatgattatgaggagatcagtgctggggacgagggcgagttccggcagagcaacaacggcattccccctgtgcaggttttctggcagtcgacaggccgcacttactgggtgcactggcacatgctggagatcctgggccctgaggaagccactgaggataaggcttcagcagctgtggagaagggggcaggggctactgtgttgggcacagcatttccctcctgggactggaatcctatggatgggctgtaccctttgccgtacctccagcccgaacctcagaagaatgagagagtgggatatctgacccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacacaca

SEQ ID NO: 123255 - DNA, 7684 bp, Homo sapiens
  Payload ID: 4202
  Gene Symbol: CUL9
  Gene Name: cullin 9
  ENST ID: ENST00000372647
  CDS Start-End: 75-7544
aggcggggccaggacggcgggaccggccgctgggtcccagcgagggctgagccgggcggtgggaggaggtcaggatggtgggggaacggcatgctggggacctcatggtgcccttagggcctcggctgcaggcatatcctgaagaactcattcgacagaggcctgggcatgacgggcatcctgaatacctgatccgatggagtgtcctgaagtgtggggaagtgggcaaagtgggtgtggaagaaggcaaagcagagcacatcctcatgtggctgtcggctcctgaggtctacgccaactgccctgggctgttaggtgagcgggcactatctaagggacttcagcacgaaccagctggggtttcaggaagctttcctcgagatccaggaggcctggatgaagtggcaatgggagagatggaggctgatgttcaggcgctggtacgcagggcggccaggcagctggcagaaagtgggaccccaagcctcacggccgctgtgcttcacaccatccacgtgctcagtgcctacgccagcatcgggcccctcactggtgtcttcagggagacaggagccctggacctgctcatgcacatgttatgcaatcctgagcctcagatccgccggagtgcaggcaaaatgctgcaggctctggcagcccacgatgctgggagtcgggctcacgtccttctatcactgagccagcaagatggcatcgagcagcacatggattttgacagtcgctatacattgctggagctgtttgcagaaaccacatcctctgaagaacactgcatggcctttgagggcattcatctgcctcagatcccaggaaagctgcttttctccttggtgaagcgctacctttgtgtcacgtccctcctggatcagctgaatagcagtccagagctgggagctggagaccaaagctccccatgtgccacaagagagaaaagccggggacagcgggaactggagttcagcatggctgtgggcaacctcatctctgagcttgtgcggagcatgggctgggcccggaacctcagcgaacagggcatgtcacctccccggccaacccggtccatctttcagccctacatttcaggccccagccttttactccccaccattgtcaccacccccagaagacaagggtgggtcttccgccagcgctctgaattctccagccgtagtggctatggagaatatgtgcagcagacactgcagccagggatgcgagtgcggatgctggatgattatgaggagatcagtgctggggacgagggcgagttccggcagagcaacaacggcattccccctgtgcaggttttctggcagtcgacaggccgcacttactgggtgcactggcacatgctggagatcctgggccctgaggaagccactgaggataaggcttcagcagctgtggagaagggggcaggggctactgtgttgggcacagcatttccctcctgggactggaatcctatggatgggctgtaccctttgccgtacctccagcccgaacctcagaagaatgagagagtgggatatctgacccaggctgaatggtgggagctgcttttctttatcaaaaagttggacttgtgtgagcagcagccaattttccagaatctttggaagaacctggatgagaccctgggtgaaaaggccctaggtgagatctctgtgtccgtggaaatggccgagagtctgctgcaggttctcagtagtcgatttgagggcagcactctcaatgacctgctcaactcccagatctacaccaagtatgggctgctgtctaatgaaccaagcagctcgtctacttcacgaaatcactcctgtaccccagatccagaagaggagtccaagtcggaggccagcttctcagaggaagagactgagtccctcaaagcaaaggccgaggcccctaagacagaggccgagcccaccaagacaaggaccgagacccccatggcacagagtgattctcagctgtttaaccagcttctggtgactgaggggatgaccctgcccactgagatgaaggaggcagccagtgaaatggccagagccttgcggggtcccggtcctcgcagctccctggatcagcatgtggcagcggtcgtggccactgtgcagatatccagcttggacacaaacctgcagctttcagggctctctgccctctctcaggctgtggaggaggtcactgagcgggaccaccctctggtccgtcctgacagatcgctgagagagaagctagtgaagatgctggtggagctgctgaccaaccaggtgggagagaagatggtggtcgtgcaggccctgcgcctcctttacctgctcatgaccaagcacgagtggcggccgctctttgccagggagggtggcatctatgctgtgctggtctgcatgcaagaatataagacttctgtcttggtgcagcaggctgggctggcggcactgaagatgctggccgtcgccagctcctcggagatccccacttttgttactggccgagattctatccactctttgtttgatgctcagatgaccagagagatcttcgccagcatcgactcagccacacgcccgggctctgagagcctgctcctcactgtccctgcagccgtgatcctgatgctgaatactgaggggtgctcttctgcagcgagaaatggcttactcctgctcaacctacttttgtgcaaccaccacactctgggagaccagattataacccaagagctgagagacacgttgtttaggcactcagggatagcaccaagaacagaacctatgcctaccacacgcaccatcctcatgatgcttctcaatcgctactcagagccgccgggcagccctgagcgtgcagcactagagacccccatcatccagggtcaggatgggtcccctgagctactgattcgatccctggttgggggcccatctgcagaactactcctggacttggagcgtgtgctgtgccgtgagggcagccccggaggtgccgtgaggcccctcctcaagcgcctccagcaggagacccagcctttcctcctgttgctgcggactctggatgctccggggcccaacaagactctgctgctgtctgtgctgagggtcataacccgactgctggatttccctgaggcaatggtcctcccctggcacgaggtcttggagccctgcctcaactgcctgagtggccctagcagtgactccgagattgttcaggagctgacctgcttcctacatcgcctggcctcgatgcataaggactatgctgtggtgctctgctgcctgggagcaaaagagatcctctccaaagtcctggacaagcactcagctcagctgctgctgggctgtgagcttcgggacctggtgacagagtgtgagaagtacgcacagctctatagcaacctcacctccagcatcctggccggctgcattcagatggtgctgggccagatcgaagaccacagacgaacccaccaacccatcaatatccccttctttgatgtgttcctcaggcatctctgccagggctccagtgtggaagtgaaggaggacaagtgctgggagaaggtggaggtgtcctccaacccgcaccgagccagcaagctgacggaccacaaccccaagacctactgggagtccaacggcagcaccggctcccactacatcaccctgcacatgcaccgtggtgttcttgttaggcagctcactttgctggtggccagtgaggactcaagctacatgccagccagggtggtggtgtttgggggtgacagcaccagctgcatcggcactgagctcaacacggtgaatgtgatgccctctgccagccgggtgatcctcttggagaacctgaaccgcttctggcccatcatccagatccgcataaagcgctgccagcagggcggcattgacacccgggttcggggtgtggaggtcctgggccctaagcccacattctggccactgttccgggagcagctgtgtcgccgaacatgtctcttctacacaattcgggcacaagcctggagccgggacatagcagaggaccaccggcgcctcctccagctctgtcccagactgaacagggttttgcgccacgagcagaattttgctgaccgcttcctccctgatgatgaggccgcccaggcactgggcaagacctgctgggaggccctggtcagccccctggtgcagaacatcacctctcccgatgcggaaggcgtgagtgccctgggatggctgctggatcagtacttagaacagagagagacctctcggaaccccttgagtcgagcagcgtcctttgcttctcgagttcgtcgcctttgccacttgctggtgcatgtggaacctcctcctgggccttctcctgagccatccactcggcccttcagcaagaacagcaagggtcgggaccggagcccggcgccttcgccagtgcttccaagcagcagcctgaggaacataacccagtgctggctgagcgtggtgcaggagcaggtcagcagattcctggctgcagcttggagggccccagactttgtgcctcgttactgtaaactctatgagcacttgcagagagcaggctccgagctgtttgggcctcgggcagccttcatgctggctctgcgcagtggcttctctggcgccttgctgcagcagtccttcctcactgctgctcacatgagtgagcagtttgccaggtacattgaccaacagatccagggtggcctgattggtggagcccctggagtggaaatgctggggcagcttcagcggcacctggaacccattatggtcctttctggtctggaactggccacaacttttgagcacttctatcagcattatatggcggaccgtctcctgagctttggttcgagctggctggagggggctgtgctagagcagattggcctctgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggaggaagaggaggaagaggaagctgagaaagaattatttatcgaagatccaagtccagccatttctatactggtcctgtcaccacgctgctggcccgtctccccactctgctacctgtaccatcccagaaagtgccttcccacagaattctgtgatgcccttgaccgtttctccagtttctacagccagagtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacggggagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggctgtgcgtacaccaggctcaggctgtacccgtacggcctgaccactgccccgtctgtgtgagccccctggggtgtgacgacgacctgccctctctctgctgcatgcactattgctgtaagtcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacaca

SEQ ID NO: 123256 - DNA, 875 bp, Homo sapiens
  Payload ID: 4202
  Gene Symbol: CUL9
  Gene Name: cullin 9
  ENST ID: ENST00000502719
  CDS Start-End: 1-282
tgttttcccaaccgcctcccacagctgatgctgcagagcctgagcacctctgaggagctgcagcgccagttccacctcttccagctccagcggctcgacaagttgttcttggagcaggaagatgaggaggaaaagagactagaggaagaggaggtcagaaccatccagtcctggacatgggaccacatcggcgactgcagtggacgtggctgggccgggctgagctgcagtttgggaagcagatactgcatgtgtccaccgtgcagatgtggctgctgctgaaattcaatcagacagaggaggtgtcagtagagaccttgctgaaggattctgacctctccccagagctgctgctccaggcactcgtgcccctcacctcagggaatggccctttgaccctgcatgagggccaggactttccacacgggggtgtgctgcggcttcatgagcctgggccccagcgcagtggggaggccctgtggctgatacctccccaggcatacctgaacgtagagaaggatgaaggccgaaccctggaacagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagccc

SEQ ID NO: 123257 - DNA, 1978 bp, Homo sapiens
  Payload ID: 4202
  Gene Symbol: CUL9
  Gene Name: cullin 9
  ENST ID: ENST00000506830
  CDS Start-End: 1-588
cagaagaggaatctcttgagctgtcttcttgttcgtattctcaaagcccatggggaaaagggcctccacattgatcagctggtttgtctggtgctggaggcctggcagaagggtccaaatcctcctggaaccctgggccacactgttgctgggggtgtggcctgtaccagtacagatgtcctctcttgcatcctgcacctcttaggccagggctacgtgaaacggcgtgatgaccggccccagatcctgatgtatgccgctccagagcccatggggccctgccggggtcaggcagatgtccctttctgtggcagccagagcgaaacctccaagcccagcccagaagctgtggctaccctggcatctctacagctgcctgcaggccgcaccatgagcccccaggaagtagaagggttgatgaagcagacggtgcgtcaggtgcaggagacgctgaacttagagccagatgtcgctcagcaccttttggctcattcccactggggcgctgaacagctgctgcagagctacagtgaggaccctgagccactgctgctggcagctgggcttcttgctggaatgagtacctgacaactcggatcgagcagaaccttgttttgaattgcacctgccccattgccgactgccccgcccagcccaccggagccttcattcgtgccatcgtctcctcgccagaggtcatctccaagtatgagaaggcgctcctgcgtggctatgtggagagctgctccaacctgacctggtgcaccaacccccagggctgcgaccgcatcctgtgccgccagggcctgggctgtgggaccacctgctccaagtgtggctgggcctcttgcttcaactgtagcttccctgaggcacactaccctgctagctgtggccatatgtctcagtgggtcgacgacggtggctactatgacggcatgagcgtggaggcgcagagcaagcacctggccaagctcatctccaagcgctgtcccagctgtcaggctcccatcgagaagaacgaggggtgcctgcacatgacctgtgccaaatgtaaccatggattctgctggcgctgcctcaagtcctggaagccaaatcacaaagactattacaactgctctgccatggtaagcaaggcagctcgccaggagaagcggtttcaggactataatgagaggtgcactttccatcaccaggcgcgggagtttgctgtgaacttgcggaaccgggtgtctgccatccatgaagtgcccccgcccagatccttcaccttcctcaatgatgcctgccagggactggagcaggctcggaaggtgctggcctacgcctgcgtgtacagcttctacagccaggacgcagagtacatggatgtggtggagcagcagacagagaacctggagctgcacaccaatgccctgcagatcctcctggaggaaaccctgctgcggtgcagagacctggcctcctccctgcgcctcctgcgggccgactgcctcagcacgggcatggagctgctccggcggatccaggagaggctgcttgccatcctgcagcattctgcccaggatttccgggttggtcttcagagtccatcagtagaggcctgggaggcaaaaggacccaacatgcctggcagtcagccccaggcctcctcagggccagaggcagaagaggaggaggaagacgatgaggatgatgtgcccgagtggcagcaggatgagtttgatgaggagctggacaatgacagcttctcctacgatgagtctgagaacctggaccaagagactttcttctttggtgatgaggaagaggatgaagatgaggcctatgactgagggggcagatgcaggaaacacctagagcagccccagagtcacggggctgagggggcgggagctgcccctgtcatagggagggggattcccagcgtctgtagtgcttcctgtttgctgaataaaggtctctttctcacaca

SEQ ID NO: 123258 - DNA, 527 bp, Homo sapiens
  Payload ID: 4203
  Gene Symbol: CAND1
  Gene Name: cullin-associated and neddylation-dissociated 1
  ENST ID: ENST00000540525
  CDS Start-End: 365-527
agtctccagcccaccggtccgctggcctcccgatccctgcggagcccctttcctctcccctcttgcaaccccctccccccattctttctcctaggcagttgcccgccgcggtctctaggccccgtttgcttgtctcagcgcccccacatccttccctgccccaccaggaggcgattcttgcgtctcaggtagcgcgaaggggctaaaccacccaccattgtggagaagggagttgctctaggccgggagaccgggcgccgggcctattcgcttgccatcctgcggcgctaggccgccttgctcgctggggcccaagctgctgcccactcggggacccggcagcctcctctctgcccgcaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaag

SEQ ID NO: 123259 - DNA, 11251 bp, Homo sapiens
  Payload ID: 4203
  Gene Symbol: CAND1
  Gene Name: cullin-associated and neddylation-dissociated 1
  Uniprot ID: Q86VP6
  ENST ID: ENST00000545606
  CDS Start-End: 438-4130
gtgaactctgaccttagctttccgtagcgcccgcgtctgccgcccccgcccccggagcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaaaaaaaaaaaaaaaggcaggaaggaaatttggtatggcagggcctaacctaaaaggttatttataaaatcaatagcactgaatgataatttttttaatgacagtcatgtattttattaatgatatctgaaagctgcttaaccattaggaattacaattctttatggttggagtatgatgatttcatcaaatgtttgaatatttacataatttttatgtaaccataattaaaccaaattagtctttttttcttcatacttttcttcggtaaatagtgaagaaataatgggcatatctaattaaccagttctagtgggtgttgtgatatctttatatctagttcagtctcagatgtatgaatatgattatatagtcatgattgaagttcaaaatgaggaagtatacaaaatcctcagccactgaaaaattcagttaacttgtttatactcctgtaagctctagttagtcacaagacaaagtatatagtaacactttgtaatgaagtaacattttctgcccacattaattttactaaagacctaaattgttaaaattaattgccaatctctggatatattatgcttagtaagtgttttgaaattaaagaccttaaacatttcagcaagtaaattttggattctagctctgttttaaattgaatcctaattttcaaaccactgctaccccagattcatacctgtttttgaaatcttgtttatggaatggaaaattgacagtatggtaatagtttattgactgattggacaaaggatattctggttttaactgacttttccatttaaataaaattcatttgataattttggttgcaaaagtggaacacagtggaagtatttggctacaggctacccaaatctcatcagataaggctgttttcttaaaggaaatgcaaaatgaaatcatatgttttccttttccaatacagtaaattgcttgttttcctatgaatatcagaaaagattttgtaaacacctttgctgtagtttcaggcaagatctttcagcaacatgtttttgctctttgtaacttagaaagttagctctgaatccaaaaactactgaagtgagtaatgcatataattttacttttttggaccctataatgccagtgtgtcaggtttcagaatgatatttagtagacagaaatacctaattttgttttggaatcttaataccctgtcctcttcataactttctagtggtgattttagcaagtttaattattttgctgaggtcttagaagacagaaagcttatgctatgtaaagtgacattgtttccagattaggaagtattggaattaatttgctattgccagtaagtaatggttgatggatattaagtgattttagtctagaatgctctcaaaaaaatagtaaagaattgtacttcagggccagatggcagctcacgcctgtaatctcagcactttgggaggccaaggtgggggatcacttgaagacaggagttggagaccagctctaggcaacatagtgagaccctgtctctaccaaaaagaagaaaaaagaaatcaacaacatgcaaccataagaatggatgagatggccctaaaagaataaggattacatataatgagaagacgtgtgggctgaaatacctagtgaacaatatttaagggaaactgaagtgcaaatggcctcacaggtttgtttttgtgtttaagacaaggtctcactctgttgcctggactggagtacatagcacgaacatggtttactgcacctcagcttcctgggcacaagtgattctcccacctcagcctcccgagtagctgggagtataggtgtgtgccaccacgtccagctaatttttttatttccttgtggagatggggtctcatgaccttgtccaggatgatctcaaactcctgggctcaagcaatcctgtgttggcctcctaaactgctgagattattgcaagtgcctccttgcccagccacatgttgttgatttcttttttctttttttttctttcttaatttttttttttttttttttttttgagattgatggagtcttgctttgtctcccaggctggagtgcagtggcgcaatatcggctcactgcaacctctgcctcccgggttctagctattctcctgcctcagcctcccaagtagctgtgattacaggcgtgtgccaccatgcccagctaatttttgtatttttagtagagatggagttttgccatgttggccaggctggtttcaaactcctgatcttaggtgatacacccgcctcggcctcccaaagtgctgggattacaggcgtgagccacgtcccccagccagtttcttaatctatacatctagcccagtccatgcccctgtttcagactattatatccaaccacctgctatacatctcataaaggtatctcaaacacagcatatctaaagctgaagtcatcatcttgccctggtttttcctgtctctttgctgatggcatcccatttacccagtcattcaaactggaaatctaaaagcctcacttagcaagagtttggaggcagaatatgataaagaacaaggactctgggaggccaaggcaggtggattgcttgaggtcaagagttcgagaccagtctggccaacatggcgaaaccccgtctttgctaaaaaaacacaaagaaattagctagacgtggtggcacatgcctgtagtcccagctgtgtgggaggctgaggcaggggaattgcttgaacctgggaggtggaggttgcagtgacccaagattgcatgcaccactgcactccagcctgggtgacaaagcgagaccctgtctcaaaaaaaacaaggactctacagatagatagacatcatatatcatattagtttgaatcctggctgttagctgttagacttgggcaaataatttaacctcaactttccctatctataaaatgggaattaaaatatttgcaccttatagggttattgtgaggattaaataggaacattgtataaagcacttaaaacagtacctgggacatactaagtaatataattgttaactcttactagcattctgtcccttttatttcctaaatatctctcatgcccatctcctaaatatctctttcctaaatatctctcatgcttttggcttaagacctcttttcctccttatctattgactggactgcggcaaatgcctgctaatcgttatttttgtgttcattcatttagcaagccaatttattacgcgcttagggtgctgccagggctacaaaagctgttgagactgtacttgatatgaagaagcttgctgattatcatgggaagactgacataaggaagcaccataaaattctgctgtatgagaggtatacacgggatactgggggttaataattgagggtatggtccattcaacatgagtgagacagaaacaattcataaaggagatgaaatgtcttgaggaatgagctcttagaagaatagttttcaaatgagtgtgcatcacagtcacctgtaagacttattaaaacagatcgctgggccctacacccagaggctgtggttcagtaggctgtagtaaaccagtaatttgtatttctatgacgttcccaggttctaatgctgttccccaaggccacaccttggaaaccaccacattaaaatacccagaaggcattaattcccagtccttcctctacacagctgcaaaacaatggtcctgaccatttcatctttgcactacatccttcactgtctctcttttgcccataggataagtacaaactagatctggttactgcctgccccaccagcctcagcatctctcacaactaggactaactttttcttctgacaactataaaatatttcccttgccttctcaagtttgctcaaggtcaagttatgccttttgcctggaatgacttgacttctcttttgttttacttagctggctgcttttcatcttgtaggttaggtcaaggactccaggaagtcttccctggacaagtaatgaagagggcataatccaagggccaactcccatgtttggaacctgactccattttcaggcacgtaatattgtcaaattccttttaaaagcacctgtctgtctgttaacgttggtgcagatactgctattcccctcctccataccattgctgatggttactgagggtatgggaagggccgactagtccagctgttcacaaacagcccttaatgtcaaactgaatactgccaacgtagttccagtttctgtatctaaagactcagcttggagtcacttgtctggactaaaagtaacccctccttgtctggtttgtgactttctgtactctgatgcccccagctttctgccttctagaaatttgtcagaatttccaaaattcttgggccttccttcttgctctatatatggttttggattcattccttttaaaaaatatttactgtcatttcagtagaattttgacacaataaatataagcacatca

SEQ ID NO: 123260 - DNA, 4091 bp, Homo sapiens
  Payload ID: 4203
  Gene Symbol: CAND1
  Gene Name: cullin-associated and neddylation-dissociated 1
  ENST ID: ENST00000544619
  CDS Start-End: 1-2313
catgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggc

SEQ ID NO: 123261 - DNA, 2786 bp, Homo sapiens
  Payload ID: 4203
  Gene Symbol: CAND1
  Gene Name: cullin-associated and neddylation-dissociated 1
  ENST ID: ENST00000540319
  CDS Start-End: 1-1329
cttattcatgcaggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaaggtaagatgtttgtgcctatttatacaatgttttagaagaagactttgctagagcaactttcacccttgtaatttactcatgtgtctgagaaaaatcaggttgtctgtgaagattttgataagcatattgtaaactataaagtgcaaaagtaataggcagtgtaacaccagttgacgtgtaagaaagatccagagccctttttattggaggaggaagtggcagtggatgcaaaatgctgtgtgcccacttgcttagtgaatagtccctagatcctttccctcaaaaaagtcccgacagattttgctgtttaaagtataaatctgtaactttttggcctgtcttaacattggaccatagttgctacccatggagggttttcttagcattgtcttgattaagtctcctgagctacctttggggctagtctgaattgtaactgtatcatttacctgaatgaggaatttttgtttttcaatataatatactgtgtttaatatcaagaattttgttataggacatggaacttttcagatatacaaaacaatctgtagaagctacttgagagaaatcatactgcgtcttatgtttggataatgaattttgcatataagtgttctttgttttcctgtgtgttcgtctccatttaaaatgtgaacagtaaaagggtgatttgaaaaatgaaaaatatatgcattgtgtctttttcatctactcttccatttagggcttttggccaagcaggacaaaagtggtaactcagcagtaattgagccatactacccgaactcctactcttaggtttccatgtgtggtagtgacctgagcctctcaaagttcaatgaagagggcctccccaccaagaagtaaaaggatgtgcttgtttaattctatgagtttatagtccaagagaaaaaggtttatgggttatcaggttttacatggattaatctgaataactggtcaactctgttatgatagtggaaacttattatgaaattgtgttccagttcagtaattttctagttctatgattctcaattctggtgcacatgagctttaaaaaat

SEQ ID NO: 123262 - DNA, 4429 bp, Homo sapiens
  Payload ID: 4204
  Gene Symbol: CAND2
  Gene Name: cullin-associated and neddylation-dissociated 2 (putative)
  Uniprot ID: O75155
  ENST ID: ENST00000295989
  CDS Start-End: 250-3609
gtctctgggggtgtgtgcaatccggcgctgcgctgtcagcagggcaagggctggggccggggccaagaccaccaagccaggcccaggcccgcccgcctcccgcggccgccacggccaaggcgtgagcacggggcggggcgggagctgctatttctgtctggtgagcgcagcccgcgcagctggcgagggagggggcgcccgcgccgccatattccctcccgccggccggctccgcggcgcgcagccaccatgagcaccgccgccttccacatctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcgctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagtt

SEQ ID NO: 123263 - DNA, 4573 bp, Homo sapiens
  Payload ID: 4204
  Gene Symbol: CAND2
  Gene Name: cullin-associated and neddylation-dissociated 2 (putative)
  Uniprot ID: O75155
  ENST ID: ENST00000456430
  CDS Start-End: 42-3752
atattccctcccgccggccggctccgcggcgcgcagccaccatgagcaccgccgccttccacatctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtgcctgggtcctctggtggtcaaagtgaaggagtaccaggtggagaccattgtggacaccctgtgcaccaacatgcggtcagacaaggagcagctgcgagacattgccggcattggcctcaagaccgtcctctcggagctccctcctgcagccacaggctccgggctggccaccaacgtgtgccggaagatcacaggccagctcaccagtgccattgcccagcaggaggatgtggctgtgcagctggaagccctggacatcctctctgacatgctgagcaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagtta

SEQ ID NO: 123264 - DNA, 771 bp, Homo sapiens
  Payload ID: 4204
  Gene Symbol: CAND2
  Gene Name: cullin-associated and neddylation-dissociated 2 (putative)
  ENST ID: ENST00000446928
  CDS Start-End: 50-382
gcgccgccatattccctcccgccggccggctccgcggcgcgcagccaccatgagcaccgccgccttccacatctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtgttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgag

SEQ ID NO: 123265 - DNA, 650 bp, Homo sapiens
  Payload ID: 4204
  Gene Symbol: CAND2
  Gene Name: cullin-associated and neddylation-dissociated 2 (putative)
  ENST ID: ENST00000454887
  CDS Start-End: 1-492
atggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggaaccaaacgccaacagtgtggcctggaacacccagtgtgaggacatgcatgctctgcttctcgggaggaggctacctcaacatcaaagccagcaccttccctatgcaccggcagaagctgcagggctttgtggtcggctacaatggctccaagatcttctgcctccatgtcttctccatttctgccgtggaggtgccgcagattggagaggacgaaggccctgaggtccaagaacattgaaacctgacagtggatgccaacagctgtggggaggagcctggtgagacgcccatgctgccacgtgcccagcaacgttggagcctgcagcgcttttcccctgccctgctctattttatcttttttaataaagatggctcctgat

SEQ ID NO: 123266 - DNA, 333 bp, Homo sapiens
  Payload ID: 4204
  Gene Symbol: CAND2
  Gene Name: cullin-associated and neddylation-dissociated 2 (putative)
  ENST ID: ENST00000626378
  CDS Start-End: 1-333
atgagcaccgccgccttccacatctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtgttgcagggcacctcttttgcaagggccattgagttgccataatcctgggaaggaggccgggagagaatggggagaggggcggagcctggcccaggttgcccgcggagtgcgatcggcctga

SEQ ID NO: 123267 - DNA, 658 bp, Homo sapiens
  Payload ID: 4205
  Gene Symbol: CUTA
  Gene Name: cutA divalent cation tolerance homolog (E. coli)
  ENST ID: ENST00000374484
  CDS Start-End: 1-335
cttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatgtgactatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 123268 - DNA, 762 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000374496
  CDS Start-End: 261-731
cttcctggggttgtttctccgtgtgacgtgtggcctttgagatcaactctcctgtaccagcgtaggccgcatgagtggggggcgggctcccgcggtcctgctcggcggagtggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatcc

SEQ ID NO: 123269 - DNA, 937 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000374500
  CDS Start-End: 133-729
cagccagcaagtggcagtttcgggttcacacggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctgttttctaatcacgtggctgccacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 123270 - DNA, 937 bp, Homo sapiens; identical to SEQ ID NO: 123269
  Payload ID: 4205
  Gene Symbol: CUTA
  Gene Name: cutA divalent cation tolerance homolog (E. coli)
  Uniprot ID: O60888
  ENST ID: ENST00000435267
  CDS Start-End: 133-729

SEQ ID NO: 123271 - DNA, 870 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000440930
  CDS Start-End: 123-662
tgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 123272 - DNA, 822 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000440279
  CDS Start-End: 254-724
gaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttggg

SEQ ID NO: 123273 - DNA, 769 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000488034
  CDS Start-End: 123-662
tgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgc

SEQ ID NO: 123274 - DNA, 837 bp, Homo sapiens
  Payload ID: 4205
  Gene Symbol: CUTA
  Gene Name: cutA divalent cation tolerance homolog (E. coli)
  ENST ID: ENST00000482684
  CDS Start-End: 108-236
aatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 123275 - DNA, 676 bp, Homo sapiens
  Payload ID: 4205
  Gene Symbol: CUTA
  Gene Name: cutA divalent cation tolerance homolog (E. coli)
  ENST ID: ENST00000488478
  CDS Start-End: 87-554
gtaagaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 123276 - DNA, 731 bp, Homo sapiens
  Payload ID: 4205
  Gene Symbol: CUTA
  Gene Name: cutA divalent cation tolerance homolog (E. coli)
  ENST ID: ENST00000494751
  CDS Start-End: 249-656
gtttctccgtgtgacgtgtggcctttgagatcaactctcctgtaccagcgtaggccgcatgagtggggggcgggctcccgcggtcctgctcggcggagtggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgagtcctgccatgatgagccctgttcctgctcatcatgaagatccccgcgatacttcaacgccttctgacttccaggtgatgactgggcccccaataaatcccgtctttgggtc

SEQ ID NO: 123277 - DNA, 1054 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000487148
  CDS Start-End: 376-846
gtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 123278 - DNA, 931 bp, Homo sapiens
  Payload ID: 4205
  Gene Symbol: CUTA
  Gene Name: cutA divalent cation tolerance homolog (E. coli)
  ENST ID: ENST00000461913
  CDS Start-End: 94-222
cacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgccttttgcctgttttttgtcatgtatgcaaatttgttgggagaatataagtgcttctagtccctgtattctctacatctttcagaatgactcagagctgcta

SEQ ID NO: 123279 - DNA, 658 bp, Homo sapiens; identical to SEQ ID NO: 123267
  Payload ID: 4205
  Gene Symbol: CUTA
  Gene Name: cutA divalent cation tolerance homolog (E. coli)
  ENST ID: ENST00000464657
  CDS Start-End: 1-335

SEQ ID NO: 123280 - DNA, 661 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000607266
  CDS Start-End: 91-561
tccggtcctcgaagcctcgaccgctacccgcaccctaaatcccagaggttggccccctgaggtgcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtc

SEQ ID NO: 123281 - DNA, 1199 bp, Homo sapiens
  Payload ID: 4205
  Gene Symbol: CUTA
  Gene Name: cutA divalent cation tolerance homolog (E. coli)
  Uniprot ID: O60888
  ENST ID: ENST00000611509
  CDS Start-End: 621-1091
acggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggaagatcgaggaagacagtgaggtgctgatgatgattaaaacccaaagttccttggtcccagctttgacagattttgttcgttctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttccaggtgatgactgggcccccaataaatcccgtctttgggtctctctgcc

SEQ ID NO: 123282 - DNA, 4313 bp, Homo sapiens
  Payload ID: 4206
  Gene Symbol: CTAGE1
  Gene Name: cutaneous T-cell lymphoma-associated antigen 1
  Uniprot ID: Q96RT6
  ENST ID: ENST00000391403
  CDS Start-End: 105-2342
agagcagccttggcgctacggaggagcctagggctaaccctcagccatacctggggctggtcctggagttgctacgcagggttgtggcagcactgactgaaggtatgagacccgattctcatccttatggttttccatgggaattggtgatacgtgcagctgttgctggattttttgctgttctcttcttgtggagaagttttagatcagttacgagtcggctttatgtgagaagagagaaaaagtttgctgtggcactttctggactaattgaagaaaaatgtaaactacttgaaaaatttagccttgttcaaaaagagtatgaaggctatgaagtagagtcatctttaaagaatgccagctttgagaaggaggcaacagaagcacaaagtttggaggcaacctgcgaaaagctgaacaggttcaattctgaacttgtgcatgaaatactctgtctagaaaaagagttaaaagaagagaaatctaaacattctgaacaaaatgaattgatggcggatatttccaaaaggatacagtcgctagaagatgagtcaaaatccctcaaatcacaagtagctgaagccaaaatgaccttcaagagatttcaagcgaatgaagaacggttggagatagaaatacaagatgcttggaaagaaaattctgaacttcaggaaagccagaaacagcttttgcaagaagctgaagtatggaaagaacaagtgagtgaacttattaaacagaaaagaacatttgaagactccaaagtacatgcagaacaagttctaaatgataaagaaaatcacatcaagactctgactgaacgcttgctaaagatgaaagatggggttgctatgcttgaagaagatgtaacggatgatgataacttggaattagaaatgaacagtgaatcggaagatggtgcttacttagataatcctccaaaaggagctttgaagaaactgattcatgctgctaagttaaatgcttccttaaaaaccttagaaggagaaagaaaccaaatttatattcaattatctgaagttgataaaacaaaggaagagcttacagagcatattaaaaatcttcagactgaacaagcatctttgcagtcagaaaacacacattttgaaagtgagaatcagaagcttcagcagaaacttaaagtaatgactgaattatatcaagaaaatgaaatgaaactctacaggaaattaatagtagaggaaaaatgccggttagagaaagaagagaaactttctaaagtagacgaaatgatcagccatgccactgaagagctggagacctaccgaaagcgagccaaagatcttaaagaatttgagaaaactattcatttttatcaaaagaagattattctccatgagaaaaaagcacatgataattggtcggcagcttggactgctgaaagaaacctcaatgatttaaggaaagaaaatgctcacaacagacaaaaattaactgaaatagagtttaaaataaaacttttagaaaaagatccttatggacttgatgttccaaatacagcatttggcagacagcattccccatatggtccctcaccattgggttggccttcatctgaaacgagagcttctctctatcctccaactttgttggaaggtcctctcagactctcacctttgcttccacggggaggaggaagaggctccagaggcccagggaatcctccggaccatcagattaccaaagaaagaggagaatcaagctgtgataggttaactgatcctcacagggctccttctgacgctgggcccctggcacctccgtgggaacaggactataggatgatgtttcctccaccaggacaatcatatcctgattcagctctccctccacaaaggcaagacagattttattctaattgtgctagactctctggaccagcagaactcagaagttttaatatgccttctttggataaaatggatgggtcaatgccttcagaaatggaatccagtagaaatgataccaaagataatcttggtaatttaaaggtgcctgattcatctctccccgctgaaaatgaagcaactggccctggctttgttcctccacctcttgctccaatcagaggtttattgtttccagtagatacaaggggcccgttcataagaagaggacctcctttccccccacctcctccaggaaccgtgtttggagcttctccagattatttttctccaagggatgtcccaggtccaccacgtgctccatttgcaatgagaaatgtctatttaccgagaggttttcttccttaccgtcccccaagacctgcatttttccccccagcccccacattctgaaggtagaatgagtttccatcagggttgagtccgacttcaaatgagcctgctgctgaacatccagaacgacagcaagaaacctaacaacatgtttgccctcttcaaaagtaattttgactgatctcattttcagtttaagtaactgctgttacttaagtgattacacttttgttcagattgaaacttaatggaactataattcccaggatagtattttgtaaatgaggatgatttaaatatgaatcttatgagtaaattatttcattttattttattctagatagtataacttttaatttgattaatccactattatataaagaatggtgggagctttatatatgtaatcttgcaggtggggaggctttaaattgtctttatgtcaagaactgtatttactgtggttgtagacaaatgtgaaagtaactttatgcttaaataagttttagttgattaaaaaaatttaaaaaatttaaaaaaagaaatatataaatatgcacaggtgggaaggtagaatactatgtaactgttagaatatttcactttaaaccaagatgatcttggatctcctgtcttatagattttatatcctctttcagtactttgagagtgtaaaacatttatagcagaaagtattcgtgtttcctctgttttcctcaagaatggtttcttcgccctccctttccttcccttcgtcttccctaagctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatgcctcccctagcagttaatgccactccagtctctgcttgaatgtaataaaataaaagaaaagtaactatttgagacatgaggtgcccttattgtacactggggcttcctatacattttccgtcttcccttgaaccaccactatcctcagctactttatgcttctgttctgttaaagccctatttgctagtggaaaaatttaactcctggtgatttttttaatactaggcctcttgccttccttccagtgagagaaaaatagaatggtaagcctagtggtttcttccttcactgttgaatactatttatccaaggtatcaaggaagaacttctaatcagaaaagacatgtattattttcacaactgggtagcatatctcactcccagaatggaagttaggtgggaattgcaagattaaggagatttttctggatttctgtctatgtatcatatccacagaactctttctagaggaattttatattgagccaggcatccatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagtataaaaa

SEQ ID NO: 123283 - DNA, 1267 bp, Homo sapiens
  Payload ID: 4206
  Gene Symbol: CTAGE1
  Gene Name: cutaneous T-cell lymphoma-associated antigen 1
  Uniprot ID: Q9HC47
  ENST ID: ENST00000525417
  CDS Start-End: 14-238
ctaatttcttcctatgtttgtcatcatatcattacataattgtgttgttatttcttttgttttatttttatttggtgggaacaactttatccagaacttttacttgccccagaattatatagatcagtttctcctgacttctttcccaacctttacctctgttggtgttctaatagttttagttttatgttctgcttttctcttgctgtggcaaggggaaggagtaaatctaagatagtgcttaattgcagttggtgaatttgatctctgattgagctctcttctctggaattctgttaaaagatgaaatgtatcgtgttccctgagagacgccctcaaattttggattagtccttcatgcaagctgggccaccaagccattgcttcttttggggacaacctgccctcacttttaaaaagcatcctagctcacatgcctcccctagcagttaatgccactccagtctctgcttgaatgtaataaaataaaagaaaagtaactatttgagacatgaggtgcccttattgtacactggggcttcctatacattttccgtcttcccttgaaccaccactatcctcagctactttatgcttctgttctgttaaagccctatttgctagtggaaaaatttaactcctggtgatttttttaatactaggcctcttgccttccttccagtgagagaaaaatagaatggtaagcctagtggtttcttccttcactgttgaatactatttatccaaggtatcaaggaagaacttctaatcagaaaagacatgtattattttcacaactgggtagcatatctcactcccagaatggaagttaggtgggaattgcaagattaaggagatttttctggatttctgtctatgtatcatatccacagaactctttctagaggaattttatattgagccaggcatccatttccacagtcttgcatttctagatacttccaaagttatagcactgttcctaaatcatttttggctttatttattaatttattgttcacttcatttcattaggttcagtatgaaacaggtattgtcatctctttgtgtctactttgccacctttccccagaataggcctgaatgagattgaaaacgttacttcagttccttgtgtctgacattgcttgtttgtaactaagaaaaataatatttgcttttgttgaatgactactaatttttttccatgaacctaataaactaaaaagaaagttgaaataataaagagtgaataagtataaaaatc

SEQ ID NO: 123284 - DNA, 4313 bp, Homo sapiens; identical to SEQ ID NO: 123282
  Payload ID: 4206
  Gene Symbol: CTAGE1
  Gene Name: cutaneous T-cell lymphoma-associated antigen 1
  ENST ID: ENST00000634260
  CDS Start-End: 105-2342

SEQ ID NO: 123285 - DNA, 1267 bp, Homo sapiens; identical to SEQ ID NO: 123283
  Payload ID: 4206
  Gene Symbol: CTAGE1
  Gene Name: cutaneous T-cell lymphoma-associated antigen 1
  ENST ID: ENST00000634570
  CDS Start-End: 14-238

SEQ ID NO: 123286 - DNA, 727 bp, Homo sapiens
  Payload ID: 4207
  Gene Symbol: CUTC
  Gene Name: cutC copper transporter
  ENST ID: ENST00000370472
  CDS Start-End: 294-727
gtccgggaaggccggtgcggaaggtggcgggggaggggacggtcggccgaaggctccccggggcgggccggcgggagtcgtagtcagtggtgatttcttctggagtcgtttcctcagctccttccagccccttgggcggcaccttctatctttgaggcgttaaaggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaa

SEQ ID NO: 123287 - DNA, 1346 bp, Homo sapiens
  Payload ID: 4207
  Gene Symbol: CUTC
  Gene Name: cutC copper transporter
  Uniprot ID: Q9NTM9
  ENST ID: ENST00000370476
  CDS Start-End: 130-951
gctggggcgtaggtgtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaca

SEQ ID NO: 123288 - DNA, 831 bp, Homo sapiens
  Payload ID: 4207
  Gene Symbol: CUTC
  Gene Name: cutC copper transporter
  ENST ID: ENST00000471520
  CDS Start-End: 69-653
gctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggacttt

SEQ ID NO: 123289 - DNA, 13747 bp, Homo sapiens
  Payload ID: 4208
  Gene Symbol: CUX1
  Gene Name: cut-like homeobox 1
  Uniprot ID: P39880
  ENST ID: ENST00000292535
  CDS Start-End: 39-4556
ccgcggcgccgggacagccccgggactctgccaggtggatgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 123290 - DNA, 2930 bp, Homo sapiens
  Payload ID: 4208
  Gene Symbol: CUX1
  Gene Name: cut-like homeobox 1
  Uniprot ID: Q13948
  ENST ID: ENST00000292538
  CDS Start-End: 27-2063
ctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 123291 - DNA, 13762 bp, Homo sapiens
  Payload ID: 4208
  Gene Symbol: CUX1
  Gene Name: cut-like homeobox 1
  Uniprot ID: P39880
  ENST ID: ENST00000360264
  CDS Start-End: 21-4571
ccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaa

SEQ ID NO: 123292 - DNA, 2331 bp, Homo sapiens
  Payload ID: 4208
  Gene Symbol: CUX1
  Gene Name: cut-like homeobox 1
  Uniprot ID: Q13948
  ENST ID: ENST00000393824
  CDS Start-End: 24-1943
actccgtctcaatatgtctcaagatggcggccaatgtgggatcgatgtttcaatattggaagcgctttgatttacagcagctgcaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctc

SEQ ID NO: 123293 - DNA, 2776 bp, Homo sapiens
  Payload ID: 4208
  Gene Symbol: CUX1
  Gene Name: cut-like homeobox 1
  Uniprot ID: P39880
  ENST ID: ENST00000425244
  CDS Start-End: 11-1909
atgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 123294 - DNA, 3031 bp, Homo sapiens
  Payload ID: 4208
  Gene Symbol: CUX1
  Gene Name: cut-like homeobox 1
  Uniprot ID: Q13948
  ENST ID: ENST00000437600
  CDS Start-End: 128-2164
ctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 123295 - DNA, 4452 bp, Homo sapiens
  Payload ID: 4208
  Gene Symbol: CUX1
  Gene Name: cut-like homeobox 1
  Uniprot ID: P39880
  ENST ID: ENST00000549414
  CDS Start-End: 1-4452
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 123296 - DNA, 4350 bp, Homo sapiens
  Payload ID: 4208
  Gene Symbol: CUX1
  Gene Name: cut-like homeobox 1
  Uniprot ID: P39880
  ENST ID: ENST00000550008
  CDS Start-End: 1-4350
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcgggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 123297 - DNA, 2878 bp, Homo sapiens
  Payload ID: 4208
  Gene Symbol: CUX1
  Gene Name: cut-like homeobox 1
  Uniprot ID: Q13948
  ENST ID: ENST00000547394
  CDS Start-End: 23-2011
ctccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 123298 - DNA, 4212 bp, Homo sapiens
  Payload ID: 4208
  Gene Symbol: CUX1
  Gene Name: cut-like homeobox 1
  Uniprot ID: P39880
  ENST ID: ENST00000546411
  CDS Start-End: 1-4212
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagagaatccaggccagagcctgaacagactatttcaggaagtaccgaaacgaagaaatgggtctgaaggtaacatcaccacccggatccgagcctcggagactggctctgatgaagccatcaagtccatcctagagcaagccaagagggagctccaagtgcagaaaactgcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 123299 - DNA, 4044 bp, Homo sapiens
  Payload ID: 4208
  Gene Symbol: CUX1
  Gene Name: cut-like homeobox 1
  Uniprot ID: P39880
  ENST ID: ENST00000556210
  CDS Start-End: 1-4044
atgttgtgcgtagccggagccaggttgaagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccagtcctccactccgtgacatcgctccaggacccgctgcagcagggctgtgtgagctcagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctga

SEQ ID NO: 123300 - DNA, 2990 bp, Homo sapiens
  Payload ID: 4208
  Gene Symbol: CUX1
  Gene Name: cut-like homeobox 1
  Uniprot ID: Q13948
  ENST ID: ENST00000622516
  CDS Start-End: 93-2123
gttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcagagagaactcgatgccaccgcaacggtattggcgaaccggcaggatgaaagtgagcagtccagaaagcggcttatcgaacagagccgggagttcaagaagaacactccagaggatttgcgcaagcaggtagcgccgctgctgaagagtttccaaggagagattgatgcactgagtaaaagaagcaaggaagctgaagcagctttcttgaatgtctacaaaagattgattgacgtcccagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaagaggttacgataaaagcacttaaagagaaaatccgagaatatgaacagacactgaagaaccaagccgaaaccatagctcttgagaaggaacagaagttacagaatgactttgcagaaaaggagagaaagctgcaggagacacagatgtccaccacctcaaagctggaggaagctgagcataaggttcagagcctacaaacagccctggaaaaaactcgaacagaattatttgacctgaaaaccaaatacgatgaagaaactactgcaaaggccgacgagattgaaatgatcatgacggaccttgaaagggcaaaccagagggcagaggtggctcagagagaggcggagaccttaagggaacagctctcatcggccaatcactccctccagctggcctcacagatccagaaggcaccagacgtggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaacaactggaagaaaaactcaaaggccaggctgactatgaagaggtgaagaaagagctgaacattctgaagtccatggagtttgcaccgtccgagggcgctgggacacaggatgcggccaagcccctggaggtgctgttgctggagaagaaccgctcgctgcagtccgagaacgccgcgctgcgcatctccaacagcgacctgagcggacgctgtgcggagctgcaagtccgtatcactgaggctgtggccacagccactgagcagagagagctgatcgcccgcctggagcaggacctgagcatcattcagtccatccagcggcccgatgccgagggtgccgctgagcaccgcctggagaagatcccagagcccatcaaagaggccactgccctattctacggacctgcagcaccagccagcggtgccctcccagagggccaggtggattcactgctttccatcatctccagccagagggagcgcttccgtgcccggaaccaggagcttgaggccgagaaccgcctggcccagcacaccctccaggccctgcagagtgagctggacagcctgcgcgccgacaacatcaagctctttgagaagatcaagttcctgcagagctaccctggccggggcagcggcagtgatgacacggagctgcggtactcgtcccagtacgaggagcgcctggaccccttctcctccttcagcaagcgggagcggcagaggaagtacctgagcttgagtccctgggacaaggccaccctcagcatggggcgtctggttctctccaacaagatggcgcgcaccatcggcttcttctacacactgttcctgcactgcctggtcttcctggtgctctacaagctggcatggagcgagagcatggagagggactgtgccaccttctgcgccaagaagttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcc

SEQ ID NO: 123301 - DNA, 6844 bp, Homo sapiens
  Payload ID: 4209
  Gene Symbol: CUX2
  Gene Name: cut-like homeobox 2
  Uniprot ID: O14529
  ENST ID: ENST00000261726
  CDS Start-End: 155-4615
ggccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccagaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccagaccccgtgcctgtgtttgaggcggcacgcagcctagacgacagactgcagccccccagctttgaccccagtgggcagccccggcgagacctccacacttcgtggaagaggaaccccgagctcctcagccccaaagagcagagagaggggacgtcgcctgccgggcccacgctgaccgagggaagccgcctcccaggcattcccgggaaagccctcctgacagaaaccttgctgcagagaaatgaggcggaaaaacaaaagggccttcaagaagtacagatcactttggcggccagactgggggaggcagaggagaaaatcaaagtcctacattcagcgctaaaggctacgcaggcagagctgctagagctgcggcggaagtacgacgaggaggcagcatccaaggcagatgaagtcggcctgatcatgaccaacctggagaaagctaatcagcgagctgaggctgcccagcgggaggtggaaagtctccgggaacagctggcctctgtcaacagctccatccgcctggcttgctgctctccccaggggcccagtggggataaggtgaacttcactctgtgctcgggccctcggctggaggccgcgctggcctccaaggacagggagatcctgcggctgctgaaggacgtgcagcacctccagagctcactgcaggagctggaggaggcatccgccaaccagatcgccgacctggagcggcagctcacggccaagtccgaggccatagaaaagctggaagagaagctccaggcccagtctgactatgaggaaattaaaacggagctgagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgagtagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataa

SEQ ID NO: 123302 - DNA, 890 bp, Homo sapiens
  Payload ID: 4209
  Gene Symbol: CUX2
  Gene Name: cut-like homeobox 2
  ENST ID: ENST00000397643
  CDS Start-End: 137-890
cccggaaagccaggttgggtcactgctgggaggtatgaggtgagactcgggtttgcaggcagggcaagttgtggggaggtgggggtggccccctatttgttgggggcagacctgccatttgaaagccaccatcctcatgtgtagccctcacatgggagaacaggattggacctgcagggatcctggctgggagcagaacctgcgtcagctcagagtcctgtgggaagggaacggctttatcgcagcctttcgcttttatttttgcacattcgctttttatttgccggtggtgctgctgacgggccctcggagcggggctgtgtctggacacttctgggagccttggacggctctggagaggaggcaggagctgcccaggaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccagaccccgtgcctgtgtttgaggcggcacgcagcctagacgacagactgcagccccccagctttgaccccagtgggcagccccggcgagacctccacacttcgtggaagaggaaccccgagctcctcagccccaaagagcagagagaggggacgtcgcctgccgggcccacgctgaccgagggaagccgcctcccaggcattcccgggaaagccctcctgacagaaaccttgctgcagagaaatgaggcggaaaaacaaaagggccttcaagaag

SEQ ID NO: 123303 - DNA, 1576 bp, Homo sapiens
  Payload ID: 4210
  Gene Symbol: CWC15
  Gene Name: CWC15 spliceosome-associated protein
  Uniprot ID: Q9P013
  ENST ID: ENST00000279839
  CDS Start-End: 124-813
ggattttgcttccgggtcgtaggcgctagctctgggcgcagaggtttctgggagccaagagtggtaatggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagtgatgatgatgatactgcagctcttcttgcagaactggaaaaaattaaaaaagaaagagctgaagagcaggccaggaaggaacaagaacaaaaagctgaagaagagaggattcgtatggaaaacattctgagcggaaaccctctccttaatctcactggcccatcccagcctcaggccaacttcaaagttaaaagaaggtgggatgatgacgttgtcttcaagaactgtgcaaaaggtgtagatgaccagaagaaagacaaaagatttgtaaatgacacactgcgatctgaatttcacaaaaagttcatggagaaatatattaaatagtacagttttatgtgcttaattaaagactgtaaaacgtaaaggatcattctgactttttttatgagttttttttttcttttcccctgtctaaattgtgtgtgggcttccccagttttaaactcctatctttttctttagtgataccttacttgataatggacttgggaataggtttaacccagtttgcattctccaaatgtttccagtgatatgttttcctgggaaaagcaaatctgcctgtaataaatatttttaatctaaataaccaaatctgggtgcccaactttttgttggaatttatgctgctagtaatacattccataatatcttttgaaaagaaaaattaccattgtgtattgtgcttgtgcattaacttgtccttttccccctgtttctctcacatttaagatgagttaattcatattttctctgcattttttaaaagagtgtaatggaagatgagagggattctattttggaccacatgttggtgtggaggagtgtcattgacagtaagcaccccaggcgtgtgtctgggagagcattgggtatcgctcacttctgcaggtacttgtttttttttctcatggccgaagaggagagctctgtaagcattcttttaaagtatacggtactcacttgtgttctggatactcaactgccatgtttcctttgaaagagattgaatatgcacctgacatgcatttagtgcaaagcctgagaaagcttcaaacaatatataaaataaaacctttggaaataa

SEQ ID NO: 123304 - DNA, 2392 bp, Homo sapiens
  Payload ID: 4211
  Gene Symbol: CWC22
  Gene Name: CWC22 spliceosome-associated protein
  ENST ID: ENST00000404136
  CDS Start-End: 158-2392
aagtgacgtacgtccggtgtaatggcggcgcggtggagctctaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaagaggactgctgtccaggtctgttttgcaagcacagagtgcttctccaatcttcacccatgtttatgcagcattagtggcaattatcaactcaaaatttccacaaattggagaattaatcctcaaaaggttaattcttaattttcgaaaaggctatcgaagaaatgacaagcaactttgcctgactgcttcaaaatttgtggcgcatcttattaaccaaaatgtggcacacgaagtattatgcttagagatgctcactttgctcctggaaagaccaacagatgatagcgttgaagtagctattggttttcttaaggaatgtggcctcaaattaacacaagtgtcaccaagaggaatcaatgctatatttgaacgccttcgaaacattctgcatgagtctgaaattgacaaaagagttcaatatatgattgaagtgatgtttgctgtacggaaagatggattcaaggaccaccccattatcctagaaggtcttgatttggtggaagaagatgatcaattcactcatatgctccctctggaggatgactataatccagaagatgttcttaatgttttcaagatggatcctaattttatggagaatgaagagaagtacaaagctattaagaaagaaattcttgatgagggagatactgactcgaacacagaccaggatgctgggagtagtgaagaggacgaggaagaagaagaggaagagggagaagaagatgaagaaggacaaaaagtaactattcatgacaaaacagaaattaacctggtctcatttcgtcgtacaatttatcttgctattcagtcaagtttagattttgaagaatgtgctcacaaattgctgaaaatggagtttcctgaaagccaaacaaaagaactctgcaacatgatacttgattgctgtgcccaacagaggacatacgaaaaattttttggcttattagctgggcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgttcttgaatgtataaaactgagtgaagaaaccactacatcatccagtagaatttttgtcaaaatatttttccaggaactgtgtgaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcagctaatgatgtaagaaagaagggacatgggaagaccagaagtaaagaggtagataaattgatcagaaaccagcaaacaaatgataggaaacaaaaa

SEQ ID NO: 123305 - DNA, 3280 bp, Homo sapiens
  Payload ID: 4211
  Gene Symbol: CWC22
  Gene Name: CWC22 spliceosome-associated protein
  Uniprot ID: Q9HCG8
  ENST ID: ENST00000410053
  CDS Start-End: 301-3027
gtggagtccccgcaggcagagacgcggagtgggggtggcgggtcgccggatcgggtgggaagtaaaagacccccaggagtgggtgcgggctcactgatacggctgtgagcggcattggagtgtgcgtgggtcttctcgctacgctcgggcccgcaagaggggtgtgagagcggctaggtccaagcaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaagaggactgctgtccaggtctgttttgcaagcacagagtgcttctccaatcttcacccatgtttatgcagcattagtggcaattatcaactcaaaatttccacaaattggagaattaatcctcaaaaggttaattcttaattttcgaaaaggctatcgaagaaatgacaagcaactttgcctgactgcttcaaaatttgtggcgcatcttattaaccaaaatgtggcacacgaagtattatgcttagagatgctcactttgctcctggaaagaccaacagatgatagcgttgaagtagctattggttttcttaaggaatgtggcctcaaattaacacaagtgtcaccaagaggaatcaatgctatatttgaacgccttcgaaacattctgcatgagtctgaaattgacaaaagagttcaatatatgattgaagtgatgtttgctgtacggaaagatggattcaaggaccaccccattatcctagaaggtcttgatttggtggaagaagatgatcaattcactcatatgctccctctggaggatgactataatccagaagatgttcttaatgttttcaagatggatcctaattttatggagaatgaagagaagtacaaagctattaagaaagaaattcttgatgagggagatactgactcgaacacagaccaggatgctgggagtagtgaagaggacgaggaagaagaagaggaagagggagaagaagatgaagaaggacaaaaagtaactattcatgacaaaacagaaattaacctggtctcatttcgtcgtacaatttatcttgctattcagtcaagtttagattttgaagaatgtgctcacaaattgctgaaaatggagtttcctgaaagccaaacaaaagaactctgcaacatgatacttgattgctgtgcccaacagaggacatacgaaaaattttttggcttattagctgggcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgttcttgaatgtataaaactgagtgaagaaaccactacatcatccagtagaatttttgtcaaaatatttttccaggaactgtgtgaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcagctaatgatgtaagaaagaagggacatgggaagaccagaagtaaagaggtagataaattgatcagaaaccagcaaacaaatgataggaaacaaaaagaaagaagacaagaacacgggcaccaggaaacaaggactgagagagaaagaaggtcagaaaaacacagagatcaaaattcaagtggttcaaattggagagatcctataacaaagtacacatcagacaaagatgttccttctgaacgaaataactacagtagagttgcgaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatactctgaacaatccagagaatcaaagaaaaatcaggaccggcgaagagaaaagtctccagcaaaacaaaaataattctacaaaatgacataaactggacatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctca

SEQ ID NO: 123306 - DNA, 3234 bp, Homo sapiens
  Payload ID: 4212
  Gene Symbol: CWC25
  Gene Name: CWC25 spliceosome-associated protein homolog
  Uniprot ID: Q9NXE8
  ENST ID: ENST00000614868
  CDS Start-End: 299-1576
agccaaaatgagacctcgacagcaaaggcctcgacagcggagcccggacctttgcaaaatctgcaagtaacgccaacgtcacaaagcgcgaccgagccctgtacgtcatcgttccgcgacgccgacgcggtgagatgacgccctcccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaacaaaaaacaggctgggcgcggtggctcacacctgtaatctcagcactttgggaggctgaggtgggcggatcacgaggtcaggagatcgagaccatcctggcgaacacggtgaaaccccgtctctactaaaaaaatacaaaaaattagccgggcgtggtggcgggcgcctgtagtcccagctactcgggaggctgaggcaggagaatggcgtgaacccaggaggcggagcttgcagtgagccgagattgtgccaccgcactccagcctgggtgacagagcgagattccgtctcaaaaaacaacagcaacaaaacaaaaccctcgaggggccactctcctgtctttactccttttcccttctctattctttcaccagaagccctcatttgaccagtgaactcctaggccctcttgacccgcacattagctgggcgatttccttgttctgctaattcctaattctgcttaaaatgtatttggatttctgtttttgaacacttatgatgccaggcactgtaatgcttgaaacccgatctttccctagagaatgtaacatacgtttttattcatttaatcacttcattatgccggggttaattatgtttattttataattggtaataaaggccacatttatttttgtaactgtttaaagagcgac

SEQ ID NO: 123307 - DNA, 3234 bp, Homo sapiens; identical to SEQ ID NO: 123306
  Payload ID: 4212
  Gene Symbol: CWC25
  Gene Name: CWC25 spliceosome-associated protein homolog
  Uniprot ID: Q9NXE8
  ENST ID: ENST00000614790
  CDS Start-End: 299-1576

SEQ ID NO: 123308 - DNA, 1160 bp, Homo sapiens
  Payload ID: 4212
  Gene Symbol: CWC25
  Gene Name: CWC25 spliceosome-associated protein homolog
  ENST ID: ENST00000618122
  CDS Start-End: 1-10
ttggaaatgaaagcataatataaagactctgtaaaggagactcgagaagctctgagccaagatccacaccccatgttgaggaacactggttttccttataaattgctttatgaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggaggtgagcatgtggcgactggcctcccttctcgttgattcacttgctcattcactcattcattccacagacatgaacacctgccctgtgctggaagctgccaggtactgggcattcagtgatgaacacttgaacatgggcccagtgcccacagagcttgccatctaatgctagagttccttggagatgctaaatatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatgg

SEQ ID NO: 123309 - DNA, 650 bp, Homo sapiens
  Payload ID: 4212
  Gene Symbol: CWC25
  Gene Name: CWC25 spliceosome-associated protein homolog
  ENST ID: ENST00000619462
  CDS Start-End: 1-180
ttgcaaatgagtctggaaaaaaaggagaagaagaaaaagaaggagaagaaaaagaagcacaagaaacataagcacagaagctcgagtagtgatcgttccagcagcgaggatgagcacagtgcagggagacatgaacacctgccctgtgctggaagctgccaggtactgggcattcagtgatgaacacttgaacatgggcccagtgcccacagagcttgccatctaatgctagagttccttggagatgctaaatatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaatta

SEQ ID NO: 123310 - DNA, 976 bp, Homo sapiens
  Payload ID: 4212
  Gene Symbol: CWC25
  Gene Name: CWC25 spliceosome-associated protein homolog
  ENST ID: ENST00000622665
  CDS Start-End: 124-330
ctggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagtcatcttggaaatgaaagcataatataaagactctgtaaaggagactcgagaagctctgagccaagatccacaccccatgttgaggaacactggttttccttataaattgctttatgaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggaggtgagcatgtggcgactggcctcccttctcgttgattcacttgctcattcactcattcattccacagacatgaacacctgccctgtgctggaagctgccaggtactgggcattc

SEQ ID NO: 123311 - DNA, 1894 bp, Homo sapiens
  Payload ID: 4212
  Gene Symbol: CWC25
  Gene Name: CWC25 spliceosome-associated protein homolog
  ENST ID: ENST00000619299
  CDS Start-End: 133-339
gtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagtcatcttggaaatgaaagcataatataaagactctgtaaaggagactcgagaagctctgagccaagatccacaccccatgttgaggaacactggttttccttataaattgctttatgaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcaga

SEQ ID NO: 123312 - DNA, 976 bp, Homo sapiens; identical to SEQ ID NO: 123310
  Payload ID: 4212
  Gene Symbol: CWC25
  Gene Name: CWC25 spliceosome-associated protein homolog
  ENST ID: ENST00000632717
  CDS Start-End: 124-330

SEQ ID NO: 123313 - DNA, 1160 bp, Homo sapiens; identical to SEQ ID NO: 123308
  Payload ID: 4212
  Gene Symbol: CWC25
  Gene Name: CWC25 spliceosome-associated protein homolog
  ENST ID: ENST00000631509
  CDS Start-End: 1-10

SEQ ID NO: 123314 - DNA, 650 bp, Homo sapiens; identical to SEQ ID NO: 123309
  Payload ID: 4212
  Gene Symbol: CWC25
  Gene Name: CWC25 spliceosome-associated protein homolog
  ENST ID: ENST00000633854
  CDS Start-End: 1-180

SEQ ID NO: 123315 - DNA, 1894 bp, Homo sapiens; identical to SEQ ID NO: 123311
  Payload ID: 4212
  Gene Symbol: CWC25
  Gene Name: CWC25 spliceosome-associated protein homolog
  ENST ID: ENST00000631731
  CDS Start-End: 133-339

SEQ ID NO: 123316 - DNA, 2078 bp, Homo sapiens
  Payload ID: 4213
  Gene Symbol: CWC27
  Gene Name: CWC27 spliceosome-associated protein homolog
  Uniprot ID: Q6UX04
  ENST ID: ENST00000381070
  CDS Start-End: 218-1636
agcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagtgaagagctcagaaaagaagcaagacaattaaaacgggaactcttagcagcaaaacaaaaaaaagtagaaaatgcagcaaaacaagcagaaaaaagaagtgaagaggaagaagcccctccagatggtgctgttgccgaatacagaagagaaaagcaaaagtatgaagctttgaggaagcaacagtcaaagaagggaacttcccgggaagatcagacccttgcactgctgaaccagtttaaatctaaactcactcaagcaattgctgaaacgcctgaaaatgacattcctgaaacagaagtagaagatgatgaaggatggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatg

SEQ ID NO: 123317 - DNA, 2103 bp, Homo sapiens
  Payload ID: 4213
  Gene Symbol: CWC27
  Gene Name: CWC27 spliceosome-associated protein homolog
  ENST ID: ENST00000508024
  CDS Start-End: 202-1347
ggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatggagcgccattcaaagatgaatttcattcacggttgcgttttaatcggagaggactggttgccatggcaaatgctggttctcatgataatggcagccagtttttcttcacactgggtcgagcagatgaacttaacaataagcataccatctttggaaaggttacaggggatacagtatataacatgttgcgactgtcagaagtagacattgatgatgacgaaagaccacataatccacacaaaataaaaagctgtgaggttttgtttaatccttttgatgacatcattccaagggaaattaaaaggctgaaaaaagagaaaccagaggaggaagtaaagaaattgaaacccaaaggcacaaaaaattttagtttactttcatttggagaggaagctgaggaagaagaggaggaagtaaatcgagttagtcagagcatgaagggcaaaagcaaaagtagtcatgacttgcttaaggatgatccacatctcagttctgttccagttgtagaaagtgaaaaaggtgatgcaccagatttagttgatgatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcagcccaccttctctatgcctgtatcttgactactggatacagctcagcagaatcacacaggcatatacaagctggtattattatggatttctagattccagcctcagctgtgtctccagtgcttccttattactcactcgccacaatgtttacttcacacttcaaactcactcaacggatcacctggctgcttgtttttttatgaaatgagagtaaatttcttcaacccgtatttctttctcttccccgcttcgagagtaaaaactaacaaaaccattccattttatttcctgtccctacctccttcctatttatttctaaatacatatcatctagcttctcacctaccactccactgaaactacttccactaaggccatctagttgataatcgactggctactttccatttttttttcttggtcttcctgctctggagatttttgtctcttttctcttgagactaatctctctcaagaaccttactatttaaagtgtgatctgtgaagcagtagcattagtatcacttgggaacttgttagaaataccgagtctcaggccctgtcctacacatttttaattagaatctgcattctaacaagatccccaggtgatttttgtgtgcattagtttgagaagcagtcctgtagaatattaatttttatccctactgctcctggatgagttcaagtttgtatcatgttagttccaaggtcagcaagttgtcagcaagttggtactatattccctgactccttagtgcaaacctatgtgcacccttttcacactcctgtaatattaggttacatatacattttttcttctttgtgtatccttatactgtaactttcttgaaggtagtgatcatatccatttacatttgtatctccatgttcaaacagcgtaggtacccaaatatttttgtaaatacatgaacaaaaaatgaataaattcttctttggcaaa

SEQ ID NO: 123318 - DNA, 2633 bp, Homo sapiens
  Payload ID: 4214
  Gene Symbol: CWF19L1
  Gene Name: CWF19-like 1, cell cycle control (S. pombe)
  Uniprot ID: Q69YN2
  ENST ID: ENST00000354105
  CDS Start-End: 88-1704
gattgttgcgcggtcgcatttttccggggagcgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagaaaagtggaaactttgatctgctgttgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctgggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctggagaagtggataccaaaaaatgtggttctgctttggtttccagtcttgccacgggcttgaaaccaagataccattttgctgctttggaaaagacctattatgagaggcttccatatcgaaaccatatcattctacaggaaaatgcacagcatgccacccggtttatagctctggcaaatgttggaaatccagaaaagaaaaagtatctttacgcgttcagtattgttcccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacaggtcattcctgtcccaatcagctgctctactactgatgacattaaagatgccttcattacccaggcacaggagcagcagatagagctgttggaaatcccagagcactctgacatcaagcagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagcttttttttttttttaattaaaagaattttttttgagacaaagtctcgctctgtcacccaagcaggattgcagtggcataactgtggctcactgtagcctcaacctcctgggctctagagttcctcccacctcagcctcatgagtagctgggaccacaggcgcatgctaccatgcctggcaaacttttttgattttttatagagacaggagggtctccctgtgttgcccaggctggtctgtaatgcctaggctcaagggatcctctgccttggcttcttaacctgctgggattacaagcatgagacaccattcctggcctagaagcctatttttaaagaaactacaatctcccatggggactgtttccctgcctcttttgtgcagtcccatggaacttgcctacagcaagaggcctaagattgaatctttttggggaaaagtcattctaggatgaaaatcctatgttaaggccgggcgcagtggctcacgcctgtaatcccagtactttgggaagccgaggcaggtggatcacctgaggtgaggagtttgagaccagcctggccaacatggtgaaaccccgtctttactaaagctacaaaaattagctgggcgtggtgccaggcacttgtaatcccagctactcaggaggctgaggcaggagaattgcttgagcctgggaggtggaggttgcagtgagccaagatcgctccattgcactccagcctgggtgacagtgaaactccatctcaaaaataaaagaataaaagtatgtctgtcatccagctcctatgtctgttatccagctccaagtacagcttgtgtatatcaacattttcaaaaacctttaaactaccaaatgaaatccagatgtttttccatggtt

SEQ ID NO: 123319 - DNA, 815 bp, Homo sapiens
  Payload ID: 4214
  Gene Symbol: CWF19L1
  Gene Name: CWF19-like 1, cell cycle control (S. pombe)
  ENST ID: ENST00000370379
  CDS Start-End: 4-765
cccatgaagctaatggatgcagcagaactggtaaaacagcctccggatgtcactgaaaacccttacagaaaatctgggcaggaagcatccataggaaagcaaattcttgcccctgtggaagaatcagcctgtcagtttttctttgatttaaatgaaaagcagggaaggaagcgttcatccacaggtagagatagcaaatcttctcctcatccaaagcagcctcgcaaacctcctcagcctccaggaccctgctggttttgccttgctagccctgaagtggaaaaacatttggtggtcaacatcggcacacattgctaccttgccctggccaaaggaggcttatctgatgaccatgtcctcatcctgcctattggacactaccagtcagtggtggagctttcagcagaggtggtagaagaggtggagaagtataaggccactctgagacggttctttaagagtcgagggaaatggtgtgttgtatttgagagaaattataagagccatcacctccagctacagattgcacagccaggagcagcatatttttatgttgaacttgacacaggagaaaagcttttccacagaattaaaaagaattttcctttgcagtttggaagggaggtcctggccagtgaagccatccttaatgttcctgataagtctgactggaggcagtgtcagatcagcaaggaagacgaggagaccctggctcgccgcttccggaaagactttgagccctatgactttactctggatgactaaaacaaagggaagaactttttatgaactccacaggaagtagtaaagctttt

SEQ ID NO: 123320 - DNA, 3278 bp, Homo sapiens
  Payload ID: 4215
  Gene Symbol: CWF19L2
  Gene Name: CWF19-like 2, cell cycle control (S. pombe)
  Uniprot ID: Q2TBE0
  ENST ID: ENST00000282251
  CDS Start-End: 29-2713
aattttcttgcggcttcttagctttacgatggcaacaagtatggcggctgctagtggtagatttgaaagtgcgaagagtatcgaagagcggaaagaacagacccggaatgccagggccgaggtgttgcgccaggctaaagccaattttgaaaaagaagaaaggcgtaaagaacttaagcgacttcggggtgaggatacatggatgctacctgatgtgaatgagagaattgaacagttctcacaggaacactctgtgaagaaaaagaagaaaaaagacaagcattcaaaaaaagcaaagaaagaaaagaaaaaaaagagcaagaaacagaaatatgaaaaaaacaatgagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaa

SEQ ID NO: 123321 - DNA, 2955 bp, Homo sapiens
  Payload ID: 4215
  Gene Symbol: CWF19L2
  Gene Name: CWF19-like 2, cell cycle control (S. pombe)
  ENST ID: ENST00000431778
  CDS Start-End: 1-1872
gttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagataaaatctagaacagtcatccaataattaagccagaaagggagtatgaacaaacatgaagtaaagatgtttgtgagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctaaaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaa

SEQ ID NO: 123322 - DNA, 2383 bp, Homo sapiens
  Payload ID: 4215
  Gene Symbol: CWF19L2
  Gene Name: CWF19-like 2, cell cycle control (S. pombe)
  ENST ID: ENST00000532251
  CDS Start-End: 1-1662
gttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagagtcacagcagcaga

SEQ ID NO: 123323 - DNA, 724 bp, Homo sapiens
  Payload ID: 4216
  Gene Symbol: CMC1
  Gene Name: C-x(9)-C motif containing 1
  ENST ID: ENST00000334841
  CDS Start-End: 171-314
gggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcaggtaccggggcgggaagcggggtttgccgaggggcctcgccccgggtctcacgccgcgggccatgcgggctggatgccgacctgggaaagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaa

SEQ ID NO: 123324 - DNA, 549 bp, Homo sapiens
  Payload ID: 4216
  Gene Symbol: CMC1
  Gene Name: C-x(9)-C motif containing 1
  ENST ID: ENST00000423894
  CDS Start-End: 177-407
gagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttca

SEQ ID NO: 123325 - DNA, 484 bp, Homo sapiens
  Payload ID: 4216
  Gene Symbol: CMC1
  Gene Name: C-x(9)-C motif containing 1
  ENST ID: ENST00000418849
  CDS Start-End: 1-340
cagagtaaacagtagcaccaaactgtcttcaggagcaaaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaa

SEQ ID NO: 123326 - DNA, 6033 bp, Homo sapiens
  Payload ID: 4216
  Gene Symbol: CMC1
  Gene Name: C-x(9)-C motif containing 1
  Uniprot ID: Q7Z7K0
  ENST ID: ENST00000466830
  CDS Start-End: 200-520
ggcgcaacgggcggcggaagtaggagcctgggaaggaagagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactataatgatccagccttttatgaagaatgcaaaatggaatacctgaaggaaagggaagaattcagaaaaactggaattcctacaaagaaaaggctacagaagcttccaacaagcatgtaggcagatactcaaatgacattcaggaactctaatattcatggaagtcattttatagtccttaaataatggactcaagcatatatgtttgctttaccttaattatggaaatattaactttatctgaaataaatattttatttcaaagttttggtttcttaaatgggaaaggagtagttactgaattgggatatggttttcctggtcattctggaccttttgaaagttttcccacaactatagttctataacagtgatactgattttttagagttcaatatggtccttatattatttttttccagtgtatatgctaatggctaatcatgggagccaaaactaaagaaaagcaggaatggacaaccttcaaaggtgttaataataactaggcagtatagcagaatggctatgaaccagaatccttcctgattctaccacttattagctatacagctgtggaagtaaatctaatacagtttgtgaggatgtactgagtattgcatatagcaggtacacgtacagtgtataagacagtgcttcagacctggtacatgctcttatattggtagttactgttagtagtagtagaggcttatttggaaactatcttagtccattttctgttgctatgggagaatacccaagaccaggtaatttataagaaaagtttgtttggctcacagttctggagtttatttgccagcagcttctggcaagggttttcatactgcatcaaaacataatagggtgtaaaaaatagaaggacaaacaagtgtgggcaaacttttataacagcccgctctcttgagaactaatacctgtaataatggcataaatccattcacgagggctccagcctcatcaccctattacctcttaaaggctccatttcttagtcctgttaaattagcaactaagtttccaacacatgaactcttgggggacacatcaaaccatagcagaaccatagataaggagatacctacttatatgaattaattttacttacatctttgatgtagaattttctaaaacataatgttcttaacctgataacttgttagtcctttaatctttcattttgaaaagttatatttctaagtgaattaccattctgtaacatagtaatggactcaggaagtagtataaaaaatttatgtcccaatttaataatttgagcttttatattaaaagttattttttccccatgagctgttaactcttccacagccattgtaactagtttcaagataagtaaattttacgtatattttcacagtcctcattaaaatcacaaatagaaattactacccactaagacaaggtttaactttccctaatcccatgcaatagatctgagagatttttttttaagaaagaatttaaataggacactaaagaatcaattcaagttccacactttactcttgagtgaaccactcaaaaaactattttacttttatttgaaatacaaagaaaccacattttcccaggccacagatcaaaaggagggagattactagagcagacaaaagcaaagcaaatatagaaatctagagaccacacagcataggggcaaacatgcccatatttccacattgacctttggtattggtgcatttcctagagcacaggaagttaactgtttttagagataaatgaaaatggaagagttactttaagaagctagtgaaatatacaatctattttatagctttgattaaaatcagaagtagcccacttcatgtagaaaattcacttatgtacatgttgctttccccatagaagccagattagattacacagtataaataatatgttcatcctccttatgtcaaagactaaaccattcattgtagccttcagaatacccatgtgtatccatactgaagatttttttcacctggtacatctgtctcagttgtgtcttgcttgcttatgggtgcctctgttgatattattccctgttaatatgtggtaacccacaggttttttaccccttaagatacaccttctccaagtagcctttctgaattaagatcagtactttgttgtcacatgattcagctcttcaagtctgaattttcccatttattttggttttctaatgtttcacataggcatgttcctgcttttaagaattcagttccattttggcagcaactcagtaagtcttacagatgtaaattttactttagctaataagggagcaagaggaaggaataggtggctttttgttatgttttcttcattctgtcgatttatggatgtactgaattgaaccttataaaaagaaatctaaagattccaaaggaagctctttagagcaagtttcagctagtatgaaagaagtcaacataaaatattcaattttaaatagattcataagctacagatgggccactgttttttggttgtttgaattttacctagaacagagatatcaagtgtagatttaaaagcttctagctgggtaaaaaatttttggctaatctttccttactaaagaaccttatacatcatttgtctaacactttaaactgtcacagtcactgactttttagtatacctgtttgatagctatcatcactgtactgtttaaatggaaaataattttctccactcaaaagctggtttaacaaatgtctattgtatgaatcatattaacaaccaacaattagtactagattttgagatctataggcaaggacaatatttcacatccacttcaatttcaaacaaaaatatttattttaattaaacaatttcttggtattgttcaaaacattaatcaagcaattatctcataagactttttttctttacaaaggaaaatttccaattttggttttaaaaaaggcaaaccagtaagctacattagagatcagatataatatacagcctatgcagccacatgagaaatagtttttgctgctttgttattacacaggtagttgcttccttcagctaaagcctggagtattgtatttcttttatgcatattgggtttggttctattacttggcaggagattgtactcccctgagtcagctgtgttcattggtcagaataaattccagcatctgacaccaattccattaatcacagacaagcttgaataagtgtaagataatagaaaaaaatatctagtgaatggcgaacattgtctatgtatgtatgctattcagtaatacagtagaagagatctgagatattgagttcaagatatatgaaactgtctatcaaaaaggataaaagtcctcctacatgaaatactttaattcaggcaaaaggtgtatgaaccaagtaaatctccaccctgaaagaacttaaatttccatgtgaagccatctttatttccttctttatttccaaataattggccacttagaataagtgtggacatttcatgatcgacaatatcaatacagcccaaaccctgatttctatgattaaaaataataattttaaatcactttctcaataaatagaatattacatttcaacacaaagtctaacaatttagaagctgctctacacaatgtgcagctagctgtagtctctttgaagaaaatgactttttatcattacacacatttatgtttatattatggcccacagaagggcagattagactgaaatctgtgtgatgctccttctactacttattgaatagtgtgtagggttacaatcatttgtttacaccccagagtttttcaactatttcatttttttttttttttttcccaattaggacttaaggaatgtgctgggacaaagttggcttcagtgatcaggttgtttcaagtcttagaattcaaacttcaattctaaaaaaattttatcaacaaaacactgtgaccaaaaaatcactttaaatcttaaatattgaaacgcaatagcatataaagatggtataacctaagatgcttttatttcattatattttcaatatctttacgcattataacaacagaaatgtaacctactcacattgccatttgttccattatgcaatttgaagaaacatgttttccttttatttttatgaacagatatttagacatttcacattttgtaaaaccacgtctacaatctccaattccattcttctgagaggcaaaattttacaattaatatagaaggcagagttttttaaacaccttaagtttacttattaattagtatagtagcatatttcagattcttagaatatggagctagagggtgctctttcatactagaaaaccaactatgttggtttttgtactattgtacagtgtgttcaaatatagatactgaagacctctgcaaaattttaatcaaaatctcctttcagtttgttaaataatttcttgggaggaccactgaaagagataagtgtcctcatggtgaaatcgtgaatctcttccaaattaattcttataaaggcagttctgattatgttgatccaagtaatgcagtggtggaaggttgggtaaaggcaaagttttagttttagtttccccaaatgctgtctcacttgatttaggaggacttggaaatacccaggaattgtcttccagagaatttctgccataagaactgtgttcctgaaagcatgtaccatcattaggaatggatctctcattgtctgtccatgattggaggattgctttctctgataaaacctttacatctcctggtaaaggggaagatgtggtatgacaaagagctttgccatttggtaagagagggggatgtcttgtgtatgttgcagtaaaattcatcaagtgcagttttgtgctgtctcttccaaggtcttcactgcatcctacaggggcacaggctaaaaagaaaacacagactaaatgtcagttttcattacatttgtgatcataaaattcgataacacttcaccaatttgaattctagaactggtgatgaaattaagatttccaagttagtgtgatcattgaggcactgtgactaggagataaatgacagatgatctgagttttaatcctggatcagcaatttactgtgactttagatatttgtctcttagctgctcctgatgtctctttccttgtctgcagaatggatatagaattcctgtcccaactatgtcatagagcttttaaaagatgaagaactacatatttttaaaagttggaaactaatacagttaaaatacaaataaagatcctgttcttggctcttattgtggctggagaaggattgcagactgttcacatgtcagtggggactgagacagttcttaagttttagcattttttagttaaatataatattcctttgctcaaactctttgtccacaggcagtccaaaagcaaattttttagaaataattgcatttttaattggtgagacccaaatgaagtttttatatatcaaaggcttttatggataaagcagtttaaataaaatttgtgaaatcttgtttcttgtaaaacacagcaaatgttaatgctactgtggtcacaatgtaggtaaagtaaaaaaaaaaaaaaaaa

SEQ ID NO: 123327 - DNA, 10301 bp, Homo sapiens
  Payload ID: 4217
  Gene Symbol: CMC2
  Gene Name: C-x(9)-C motif containing 2
  Uniprot ID: Q9NRP2
  ENST ID: ENST00000219400
  CDS Start-End: 417-656
cgaaggtcgccgagccccccacgccgctcttcttagaagtgtgcaaccttgcaccagtagtggacttacacataggctccgttaggacctggcttatgtgctcggcttgtggcttagacgctgccgtgccccagtggactcactgtgcctccccccacgacggacggaaatgggcccctccaggacaggcggcgcatgcgccttggggcccgcgggcggcgggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataatttttttctcctttctcttagattcttttggcattagaggaaaatgttgccattaggctttttctttttgacaacatgatgttgaagaattctggggaaatcccagcagtgttaactatttgaaaatgttgcaactttattgtttttaaagagtgattttctaaatgattaaaaaaaattttttttttgagacatagtgttactttgctgcccaggctggagtgcagtggtgcgatctcagcttactgtaacctccacctcccggattcaagtgattctccagcctcagcctctctagtagctggggctacaggcgcaggctaccatgcctggctggtttttgtatttttggtagagacagagttttgccatgttggccaggctgatctcaaattcctgagcttaggtgatccgcccacttcagcctcccaaagtgttgggattacaagcgtgagccactgtgcccagactaaaagattaaatatttacacttaacattgataaaatttcatctggttaggaattgagtcttagcagactttgctttcccatttggttgaatgtgtccactcgaggtgccagttaactcctggacattaaccttaggccagtgtgtctcctctctgctgagtataggactgttcttcccgtgcccaattctagcagtcatttcaccagtgttccttctgccaagtgtttctgagacctgtgacaatctggaagtcagcagcttccagctgcagtcacagcaggggcttgatcttgtcaggtgtcagggaacagactcagctgtgagctccttctagtggagttctgtgtataatatccagcatgaggccttgttggtgttggtgtttaataagtgacttccccatcacaggaggtattcaagaagctggactttcgctcagtacgtcgattacagagcataacagacattcagtgaaaggatggggaaagaaccagaattaattctgaagtaccttccaagacaaagtgtatgaatatttattcagtccccctagtgtcaggcagtagaaatacagaaatgagacattttgcctttagaatcttgtagttaactgaaaagttgacttttagtcacctgtaatcatcaaagtgccatgattaggtagatgtcatagaagacagaggactttcatgttcagtcttcatgaagaaggagctattccaagaaagctatttagcaaagatgacctttgacaaatgagtgaaaatgggatacattctgaggcgcactttaaggcatttagcatgactagaatatgggagcttagagtggaggaagatcatagacagctttgaaatctgttggaattttattttcagtgctgtgatgaccagttgcaggttttaatatggtgattagggatttgggtagaggagttagttggaaggctgatatatttcaatttgtattttagtaagtttttttggttatagtttgggggataaattggaggggaaggaagataacgcccaaggagagcaattaggtttttgtgctaacttgagtgagaaatgagggcctggatgaaagatgtggctttggggattaggaggagtgacgattcaagcattgagtcagcatgactgactaggtgtagggtttaaggaagtgtctaggatgtctcaggcatttgatttgtgcctgcttgggagggagtactggggaggtgaagtgtgtgtggaggatccagcgggagagggcttccgggttgctgctgggtatttaggtctgcagcttgttagagtcacctggattagaacaaaattgggagatgtcagcatgcagatgccagctaaggccctgtaggccaatgtcagtagctgaccataagagcaggatgaaactttggaagttcattcttaaaaattttataagtaatatatgagtacgtttttatgggatattcaaaccacctactgtttttaggtcttactctcttgtgttgcagctgttgctgatccctgtagagtaaagtacacactgaaggctatggcaatgatctacctttccagcttcctctaggaagggagtttgacaaataaaatgctagtgaactggagcacagtgagcaagggggagggtggcatgagctgaggacacaggtgggcagggccagaacacacaggccttggacatcacctcagggaacttgcatgttatttggagcataatggaaaaccattagaaagttttagggagtggttatgatttcatttatttatattttataaagatctttctggttattcggtgaatagttatggttaaaccagttcaacccagtgacagtacctgtcacatagagttattgtgaggattggttgagatgtatgtgatagattatctggcacaaagtaagggccccctcaatattgtttttctctcaagtgcacccaaattggggtattggaaacacttcctccgtagtttggtagaaggcaccaaatcactagggctgataccgtttgagtggggccccagctgatggggcagggggtaaaggggtgaggggcttaatatgaggcagaaggaagggccaggcctctagaactcatcccaagccggccccattctctggctccctgtacatcctgcctttccatagaggaagccagtcccaggggtggctgcatcttattccatgctttacatctcatcagccttgctgactttccccagcctgctgtagatcagagtgaaatctgtttctcctgtctagagcaagcgcactttttcctgaggatttccaaatattttgaattcccatatgcagtggaagccgaagaagctggagggagagtggggttgggaggtgcagaggttccatgtcttcttgcctttatgaagcttctggcattgtgctgggtgcaggtgataccatggaataagatggatgtggttctagtgacggttcacatcacgaaggaccatctgtgtcctcttagggagtctggctttcctgctaagggcaacaggaaggcattgtagggtctgtgcaggataccaagtgaaggaagagatttccttactgtggacttgcagacgataagtaaacttttgggtcataagagaccatctcttggaagctgaagaacttaggccaaggttttcctgagaaatctagttttgcagaatgttgtgaaccttgatgctctggtgacagtgaattaatggtttattttaggaagcactacacaattttacttaagagtgaggctagaaagttgagctgtttctcaccttttataaatgaagtttaagatcagattaatctccatggagtttttagctcaaagcacaattagttttctatagaaagggcttgggctgaaccaaattatgccattgatctgcctggtagacatacaaatcattctgttcttagaaaaaaacaaaaaaaacgaaaaacaaaaaatcctcactgtcccaagggagttgctcctttcactacaccctgatattgaaaccctgatattgaaatttgtgccccttaaatgatatcatattcagggaaccagctataccagaatctaccttaatccatagacatccctgcctcctctagagaggtcactgaaggagataagtacatagcagaaagtggtgaagggaaagcaaagggatgctttattgttaccagtctcctgcctctggtatcagatggagcaggtggcctgggctagaggcctgtggggccatttctgtcctctaagctctagtctgatctcaccggcagctggtcacatgggaggacaggagatggagaacaagactgacagtagggaggggagagcagagacaggtggctgagtttctctcacttagagaaaagaaactggctgagtgtataccacgtctgaagtgagcaaaagggaagattgcccaaatcctgtaaaggaccttttttgtggtattaatgctattcttttttatgacaaaatgtttcaggtttacagaaaactatacagactaatacgaacactcacatagctgctatctaagtcatacttttaaaaaatacaggtttaaaaaaataataatacaaaagtgggtaaagcctcctgtgtttgtcaccccaagcccgttccacttatttctttattggtggtaactactaccctgactttgatatatttcattctcatgcatgatttcatacatatatatatatgcatgatttcatacatatatatatatatatatataaaatgtatgtatgtcagtatccatagccatattttattttgcatgtttagtcattttacttaggaggcgtcatgatgtgtgtagcctttggtagcgtaccttttttttttaaaaaaaaaatactatgttgataaatgaggttcttgtttatttgttttgcctgctatatagcattttgttgtaggcctataccacggtttatgtatttccccgtagatggtcacttagatatccagtctttgctattgtaaacttcaatgaacgttcttacttaccttcttgtccaatctgggagagtgtttttaggtataaacctaggattttaattattgggctgtaaggtatgcattttcaaacttactagaagttgctaaattacaccccaaatgtttttaagattttatgatttgtatttttgttgttgttttttgagacagagtctcaccctgtcacccaggctggagtgcagtggtatgatctcagctcgctgcaacttccacctcctggcttcaagcaattctcgtgccttagcctcctgagtggctgggactacaggcatgtgccaccatgccctgctaatttttgtattttttagtagagatagggtttcaccatgtccaggctggaaaattttatgatttttaaaatagtgttcttatacatcttttgctagatttgtgtctaaggggtatttttaaaattacttattctaatatctcttaaaatttttttataaagcagggattataggcatgagcccctgcatccaatttattctaatttcctattactgatacattggagtgtaattgacttctgtatatttatcttacattcagaaggcttgccaaactttcttaataattctggggcctatagattattttagatttttctatgtagacagtcacatcacttttgaatagtaacagtaatgaatcatttgtttctttccaatgtttatacttccttattttattgtacttagaacattcagtataatgtttaatagatacatcagacttctcttgtgactgatgttaaatccttacatttcactgacaagtagcaaatttgtagtaggtttttggaagatgtctgttcctccctaaggaagttccttttggtaattgtagatagacttgctcaacctctactgcacctccttctagtgtgccttcccatatttgtgaaactcaaaagctaaatactgcattttctccaattcctttacagttaggattccagataggaattaatgtccattaatcggtgagatttggatttggaattgacttaaattgagagagagacggtccatgaagcatccattttctggtatggatcagagcagaaatggtggggttatagagcctgcaactgtagccgcagttttctcttttttgctagacagctttttaattgcaatgtggctctgaagtttcttcatccctcccaatggtcaggtaagttatttaaatacctgtctgtcattgcttactacactgtccttttaatcttcattatataaacaataaagacatacttaatgctcaccgctagtcttgtgttaatatctccctagtcattttggttgtctgagcctcattttccagcagattcctaaggaagttctcatgggaacaatattccatgggtttttttcttttctaattgagacggagtcttgctgtgtcacccaggctggggtgcagtggtgtgatcttggctccctgcaaccttgctgcctgggttcaagtgattcttgtgcctcagcctcccaagtagctgggattacaggcatgcaccatgatgcccggctaatttttttgtccttttagtagagacggggtttcaccatgttgcccaggctggtcttgaactcccgacctcaagtgatccacctgcctcggcctcctgaagtgctgggattacaggcctgaaccaccgtgcctggctctcttcatcacttctgttgtccctatcctgttcaattttttttctgctccctgcagttcctcctcactttggagtcttgtcctgggagggaaccctacgggatcagttttgagagttcattaatgctaaattgttccagccccttcagaccttcctgtgggccccatttactgaagtgggcaagaaccttcccagtaccaattgctgttctcaaattggccctccgggctttgcagtgaatatctgttgttttgggttcttcggtccttagttggttcaggtaccttgtgcctccctgtgctgctttccacatcgatgctgagacctcccaggactcctctggctcttgatgctctgtcctcacctcactcatttgtattttgggatatgagggttacattttaacctaattttgttgtaaatactgtctctcctcctgccctttttatatcataaaaaagatagttgcttccacagtcacaactatctttccagaatttcccaccagtaactttctgacacacacacttaacttaccaatgggaaacatattttttctgctcagagcccaaggtgagtcacactggccttactcttacctccctatgctggcaagtgttatgttttctagttaatgttttcttagaggattaccatctcctggctttatgtgatattcttgtttctcacaccattcctcgtagagactcagtatcttccatctttttccattgtgtttatgaaaacctcacttcctggtacctggaactggtctaggctgcatagcatgtgctgatgcacttactttctggtttacagttctctctgatttcaacccccaaggattttctttcctttcttgtgagctcaactacacctttaaaaactatatttgatatatgctatctagtatttgtagatagctttttagcaggagtgttttcagattacctaatgagctattttaccagaaacagatatcctgtacataaaattttaccttggaaagactgccccctaggaatgattatattttcaacagttagagaactaactcattcctagaagatggggggaggatgggagttggggagggcatggcaaagagaggagttataagagcatcttctgttcagagaccttcatcttcatctgcatttgggccattagactgtggtccgtgggccagcagctttagcgtaacccgggaaagtttgttagcaacgcagaatctcagccgtgtggggtggcttgcgcctgtaatcccagtactttcgaaggccgaggtgggagaattgcttgaggccagggagttcaagaccagcttgggcaacatagtaagaccctgtctctacaaaaataaaaataaaaaaaagaaatggagagttttagaccccaccctgacctactaactgagaatctgcattttaatgaaatccccagatgatttgcatgcatataaaaattggagaagcattgacttagactctttctgatgtaactgccttccataaaatgcctacttctttagggttaatgaccttcatccactcttgtcatcacttctagcttactcttttttctgcatttaatttttaagcagtttcctcaaataacttttgtatttaagtttttgagaaaagttcttattggtgatatattatgttgagaatgtgatttgaaaaaaaaataggaagcgttaatatggtatgttgtcattgaatatgacagcaaaatcttaagggcaaagctgttacgaaattctcagggcatttactttttcctcaactctggcgagtagagggctaagaaagtaaagcattctgcaattctgcatacagaaatttagacctggctatttttcactggagtatttgcttacagagcatccatatttcctaaaatgctatgattggattattgagctaatgattggacttgctacaaatattgaaaagtacgaggaaggctgggcgaggtggctcacgcctgtaaacccagcactttgggaggccgaggcgggcggatcacgaggtcaggagatcgagaccatcctggctaacacggtgaaaccccgtctctactaaaaatacaaaaaattatccgggcgtggtagtgggcgcctgtagtcccagctacttgggaggctgaggcgggagaatggcgtgaacccgggaggcggagcttgcagtgagccgagatcgtgccactgcactccagcctgggcgacacggcgagctccgtctcaaaaaacaaaacaaaacaaaacaaaaaacgaggatatcttttcaaagcagatacaattaaaggaaaattctctagggatagttcaagttgctgtgatggctttatctgctaaaattttagttaagctagcagataatttatgagcaagttcatgatacatggaattcaggttatgtgtagactgaaagctctctgggctgacacctctctgggcagacaccacattattcctgtatctgcagctcttaggacagtggttaacacataattggtattcaataaatgctttttcactgaatgaatgaatttttagtgaataaagaataaataaagtgttgaagtagcccaaaggactttaaaatttacattttctttttctgtagatcacttgataggtacattgttggatgtaattaaaataagacgggctctatatgtctacgaataggacagtagttaaataaacaatgatgcatttacacaaaggtataccatgaatctatacaaaggaatgaagatttcgtgtgtctgtatgtatgactatatggtgattatataaagaaaagaagaaattcctaaaacttgaaaacaagctgaaacaaataactcgagtacatgtcaagttgattttataaccacagaaaggaaatgattataagtgttgttcaaatacaatattttgactttacatctccagaaggtgatacatcctgaagataaggagaactgcaaaaaaagtaaaactttataataaaaataatattgttttgaaattggtattataaaatatcacgttttaaagttatgatgttagtgtcagtagaaaccaagattttcaacctaagaccaaaacaagatacaagtgtaaaattcaagtcaaaacatgcattaaatttgaattggaaatagta

SEQ ID NO: 123328 - DNA, 399 bp, Homo sapiens
  Payload ID: 4217
  Gene Symbol: CMC2
  Gene Name: C-x(9)-C motif containing 2
  ENST ID: ENST00000565108
  CDS Start-End: 189-356
ggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaattacgtagaaaacaggaccaagagcagggagcatggcattgcaatgcgaaagaaactttttaatcctccagaggaatccgaaaaataaattgtattttcactcgatgccttggctgagagaagacctaaag

SEQ ID NO: 123329 - DNA, 640 bp, Homo sapiens
  Payload ID: 4217
  Gene Symbol: CMC2
  Gene Name: C-x(9)-C motif containing 2
  ENST ID: ENST00000565925
  CDS Start-End: 248-472
cacggtggagcggtggagggcgtcactgggtttcggcgtctggcaagcggttcagctgtctgctccctagcagccggccttcgggtcgggcgtctccgccggctactgccgcttcagttctcccggtgtggccacgagtcggcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaag

SEQ ID NO: 123330 - DNA, 919 bp, Homo sapiens
  Payload ID: 4217
  Gene Symbol: CMC2
  Gene Name: C-x(9)-C motif containing 2
  ENST ID: ENST00000567593
  CDS Start-End: 209-319
cgtctggcaagcggttcagctgtctgctccctagcagccggccttcgggtcgggcgtctccgccggctactgccgcttcagttctcccggtgtggccacgagtcggtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatgattccgtccaggatacacattacacttagttcttgtcactctttaggctcctgttatctgtgacattttctttgtttttgatgacccgaaaaggtttgaggcataatggccaggtatttggtagaatgctcctctgtttgaatttgtcttgttttcctcataattggattgggatcatgtgttttcggatgaagaccacagagcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctg

SEQ ID NO: 123331 - DNA, 801 bp, Homo sapiens
  Payload ID: 4217
  Gene Symbol: CMC2
  Gene Name: C-x(9)-C motif containing 2
  ENST ID: ENST00000570086
  CDS Start-End: 178-333
cacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatggcactagaacagttatattcagcgctgacacttctgattataatggaattattctaaaagtatctgctctttgatggctaccattctgtgtttaatgcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataattta

SEQ ID NO: 123332 - DNA, 663 bp, Homo sapiens
  Payload ID: 4217
  Gene Symbol: CMC2
  Gene Name: C-x(9)-C motif containing 2
  ENST ID: ENST00000565613
  CDS Start-End: 157-381
gtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagggaccatctggacttcctttggagatgtcttagcatattttaatgtagactatattttaatttgctttgtaacttattttattggcctgctacaaagtattatcttctgaagagtttcccttaagacccttctcaacctgattgctgggggcaatccagtagacgtgattaaagtacgtagaaaacaggaccaagagcagggagcatggcattgcaatgcgaaagaaactttttaatcctccag

SEQ ID NO: 123333 - DNA, 825 bp, Homo sapiens
  Payload ID: 4217
  Gene Symbol: CMC2
  Gene Name: C-x(9)-C motif containing 2
  ENST ID: ENST00000568228
  CDS Start-End: 386-541
gggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggaactgctataccagtttccacagtggctatcccagtttacatgcccgcccacagtgcgcaggagtttcagtttctccacatcctctttagcgtttgttattttctgtttttttttcagcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatggcactagaacagttatattcagcgctgacacttctgattataatggaattattctaaaagtatctgctctttgatggctaccattctgtgtttaatgcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatg

SEQ ID NO: 123334 - DNA, 424 bp, Homo sapiens
  Payload ID: 4217
  Gene Symbol: CMC2
  Gene Name: C-x(9)-C motif containing 2
  ENST ID: ENST00000564174
  CDS Start-End: 224-391
gtcactgggtttcggcgtctggcaagcggttcagctgtctgctccctagcagccggccttcgggtcgggcgtctccgccggctactgccgcttcagttctcccggtgtggccacgagtcggtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaattacgtagaaaacaggaccaagagcagggagcatggcattgcaatgcgaaagaaactttttaatcctccagaggaatccgaaaaataaattgtattttcactcgatgccttggctgagaga

SEQ ID NO: 123335 - DNA, 671 bp, Homo sapiens
  Payload ID: 4217
  Gene Symbol: CMC2
  Gene Name: C-x(9)-C motif containing 2
  Uniprot ID: Q9NRP2
  ENST ID: ENST00000565650
  CDS Start-End: 267-506
gggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcggcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttg

SEQ ID NO: 123336 - DNA, 528 bp, Homo sapiens
  Payload ID: 4217
  Gene Symbol: CMC2
  Gene Name: C-x(9)-C motif containing 2
  Uniprot ID: Q9NRP2
  ENST ID: ENST00000565914
  CDS Start-End: 199-438
cagaagcggtgtattgcgcctcagcatggaggaggacgtgaaggcgtacggagtctgggagtagtacaccacgtagattttggatataagtaatgtgcaggtttcttacatgggtacattggatgacactgaggtttggggtactgttgatcccatcatgcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccata

SEQ ID NO: 123337 - DNA, 683 bp, Homo sapiens
  Payload ID: 4217
  Gene Symbol: CMC2
  Gene Name: C-x(9)-C motif containing 2
  ENST ID: ENST00000561614
  CDS Start-End: 1-164
acttgcacactgaagaatgcaacgtcttgattaacttgcttaaggaatgtcacaaaaatcacaacattctgaaattttttggttattgtaatgatgttgatcgggagttgagaaaatgcctgaagaatgagggaccatctggacttcctttggagatgtcttagcatattttaatgtagactatattttaatttgctttgtaacttattttattggcctgctacaaagtattatcttctgaagagtttcccttaagacccttctcaacctgattgctgggggcaatccagtagacgtgattaaagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 123338 - DNA, 766 bp, Homo sapiens
  Payload ID: 4217
  Gene Symbol: CMC2
  Gene Name: C-x(9)-C motif containing 2
  ENST ID: ENST00000486645
  CDS Start-End: 198-350
cgggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatgttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 123339 - DNA, 890 bp, Homo sapiens
  Payload ID: 4217
  Gene Symbol: CMC2
  Gene Name: C-x(9)-C motif containing 2
  Uniprot ID: Q9NRP2
  ENST ID: ENST00000564249
  CDS Start-End: 411-650
cacattgtgctgatccattgtctgttggactcttgggttgcttccatgttttaattattgtgaataatatgccgtgaacatgggtgttcaaatatctcttcaaaaccctgcatttaattcttatgaaaatatagccggaagtggaattgttggatcatatggtaatttcatttttaattttttgaggaactgctataccagtttccacagtggctatcccagtttacatgcccgcccacagtgcgcaggagtttcagtttctccacatcctctttagcgtttgttattttctgtttttttttcagcagtagccatcctaatggatatgggttggttcctgttttctatttggaactttaaaaaaaattaaagcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctaca

SEQ ID NO: 123340 - DNA, 871 bp, Homo sapiens
  Payload ID: 4217
  Gene Symbol: CMC2
  Gene Name: C-x(9)-C motif containing 2
  ENST ID: ENST00000570195
  CDS Start-End: 174-455
gtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatgaaacgtgcatcatatctgcaacttactcggttcagaagaaaagctcgggtgtatatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaataa

SEQ ID NO: 123341 - DNA, 573 bp, Homo sapiens
  Payload ID: 4217
  Gene Symbol: CMC2
  Gene Name: C-x(9)-C motif containing 2
  ENST ID: ENST00000562713
  CDS Start-End: 248-472
gggcgtcactgggtttcggcgtctggcaagcggttcagctgtctgctccctagcagccggccttcgggtcgggcgtctccgccggctactgccgcttcagttctcccggtgtggccacgagtcggattttggatataagtaatgtgcaggtttcttacatgggtacattggatgacactgaggtttggggtactgttgatcccatcatgcaggttgcactgctgtgatccatcctcatctcctaaagatgcatcctgacttatctccacacttgcacactgaagaatgcaacgtcttgattaacttgcttaaggaatgtcacaaaaatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtgatcctcccacctcagcctcctgagtagctaggacgacagtacgtagaaaacaggaccaagagcagggagcatggcattgcaatgcgaaagaaactttttaat

SEQ ID NO: 123342 - DNA, 481 bp, Homo sapiens
  Payload ID: 4217
  Gene Symbol: CMC2
  Gene Name: C-x(9)-C motif containing 2
  ENST ID: ENST00000630396
  CDS Start-End: 200-481
ggcgggggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggttgcactgctgtgatccatcctcatctcctaaagatgcatcctgacttatctccacacttgcacactgaagaatgcaacgtcttgattaacttgcttaaggaatgtcacaaaaatgaaacgtgcatcatatctgcaacttactcggttcagaagaaaagctcgggtgtatatcacaacattctgaaattttttggttattgtaatgatgttgatcgggagttgagaaaatgcctgaagaatgaggttcttgctctgtcacctaagctggagtgcagtagggtgatcgtaactcacggaagcctcaaactcaagtga

SEQ ID NO: 123343 - DNA, 864 bp, Homo sapiens
  Payload ID: 4218
  Gene Symbol: CMC4
  Gene Name: C-x(9)-C motif containing 4
  Uniprot ID: P56277
  ENST ID: ENST00000369479
  CDS Start-End: 443-649
gttctgttcagtatttggcaatcacttcatccactactgcagtgcacccacccttgggcctggggggagggagtgggttgaaaaactgctcaagaaacagaagtttagcaagggtcatgaagaatactgcaagtgaaactgcagagagaggttacgtaggcagaaagcaagtcaacaaaagcacttagtcaggatccgtaacttgaaattgactcctttggaaattgccatagaacccttaatggacatcatcggctggacctgggatctgatgaatcccacaaaagtcagcaccttctacagaacagatgccctgatcaccaaggacttggtactgatttagagagaagagagcagctcctagcagcatcaacatctatttgtcgcttatttgccctgcagcaattcacctgcctttccttctcccatcctttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaaga

SEQ ID NO: 123344 - DNA, 1107 bp, Homo sapiens
  Payload ID: 4218
  Gene Symbol: CMC4
  Gene Name: C-x(9)-C motif containing 4
  Uniprot ID: P56277
  ENST ID: ENST00000369484
  CDS Start-End: 680-886
gggcggggctgtgggggcgaggagggggcagcgggcgcgcggctggcgcgcgggggcgggccttggggcacgggggcggggcccgcccagcagcacctgggaaacgcccgcgcggtttggggcaggcgtggccgtcggggcggagggcggtggccggccgcggtccgggcgtcaggccgggcggcgggggcggcagggaggcggcgctctggggccgcaggcggacgtactctgtgagcggcgcccgggcgcctgggcaggcgcctcccgagtaccggcgcccattttgcccgcccgctaaggagacccgtgcgcggcctacacgcttgggggacagccctttaagacgacatctccgcgaacgccggcctcttgagccagggggacgctcttttgaaagtcagtcccaaaacagttaaggttttattttattttgttttatttccaagtcacagcccccgaatctcgtacaactctccctggaccacttccggttgccggcccgcgcctcataacttcggttcgagtgacctcggcccgggatgcccctcggctcaccccgggctcacgtcgcgatcctggcttgagtggcccagggtgggagacctggaagttttagcctagctgttctcaaggcggattaattagcccaagaaacattatattcatttttctggatatgccgcagaaggatccgtgccagaagcaagcctgtgagatacagaaatgtttacaagccaacagctacatggaatcaaagtgtcaggctgtcatccaagaactgcgtaagtgttgtgctcagtatcccaagggaagatctgtcgtctgttcaggatttgaaaaagaagaggaagaaaacctaacacggaagtctgcatcaaagtaaagttcttctgaagtgctgctccatgtttccaccaaatgaattttttttatcctcctgactcttcaggccaggtagcagcaaatagcaaatgaaaaagtcagctacaaaagttaatgaatatgccatctatgcagaacaggcagaaatataaacacattaaaagacaaatatgtagaatgtaatatactgagctgctaaaataaacctgtttaagagaaaaa

SEQ ID NO: 123345 - DNA, 5072 bp, Homo sapiens
  Payload ID: 4219
  Gene Symbol: CLMP
  Gene Name: CXADR-like membrane protein
  Uniprot ID: Q9H6B4
  ENST ID: ENST00000448775
  CDS Start-End: 342-1463
agctgaattttttttttccctctctctttcttcactcctttttctttccaaacagggaaaagtgttccacgaagcggtagcgccttttcgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcaaggaaggataaaaggaagttcagtattgtaccacacttggaacttcctccatttcttccattttagaaggatatgaacctggaacttttgatgattctaagccttaaactatcaaaaagatcagggattgccaatgcttctaatggcactgcaagtatatgccataaccgttccctcctaaaagtgaaaaatgagagaaattcagtattttcccaggctcagcatccagaagtctagctctgggctggaagaaaagggtactaatatttagggaagagatgagaataagtagtgggtggcaggagagggctgagctagtgcctgctaacattttagttgtatcttggaaagatttagcaaaaataactcaccaggatagctgctgaagagttgatgaatgggagaagaaagatgtttgagaaataaagaaaacagcagcctgcaatacaataacttgcctttttaatagttttgattactcttgatacctacagcacaaatgctggacctgaatcagctcttcaaggaccctagcacaaatgtcaactgatcacctctgggagagtagaaaacttttttttttttgagacgaagtctcgctctgttgcccaggctggagtgcagtggcaccatctcagctcactgcagcgtccgcctcttgggttcaagtgattctcctgccttgtcctcctgagtcgctggtattacaggtgcctgccatcacacccagctaatttttggagttctgatagagacagggtttctccatgttggccaggcttgtctcaagctcctgacctcaagtgacctacccacccttggcctcccacagtgctggaagccactgcacctggctcagaatacttttttttttgagatgcagtcttgctctcatcacgcaggctggagtgcagtggcgtatctcggctcactgcgacctccacctcccgagttcaagcgattctccttcctcagtcccccaagtagcttggattataggtgtgcgccaccacgtacagctaatttttgtatttttagtagagatggggtttcgccatgttgaccaggctggtctcaaaacgcctgacctcaggtgatccacccacctcggccccacaaagtgctaggattacaggtgtgagccaccatgcccggcccagaatactttttaaaagaagagcaggttagaggaaagaaaaaaattgatgctgaatgtggtgatgaaagcatgtttctaaaatgggaagcagatgcttaaagaggaaagactaatctgggattttgccccatttctctggtttttcactcctatatttaattctcacaatcgtgtcgtcacatagtgcaaaaaacaaaattcttgtaaagtccccaggagtttatgcttgggtgaaagttttagcctgagtattttcttcctctaaaaaaggtgggaaatgagacattgaggaattaacatataaatgtctgctatgggtttaagagaactggcgtatttggaatgcttcttacactaacactgtctcattgtaaaatataaaaccccttactctaactacatttttattcctctggtagtgtggtatccaggcaacatatcacttctgctatgtaattctaagaattctcatttctagagtacctgagccaaacaaatacacaacggaagctgcagctgtatcatcactagcaatttgctcatcattatttactacctttgaacctaaggtttcctgcctatgcttttgaaagcaaaaatcagtctcctttgcatgaaaaagagccttagatttttaaacatgttagttaccagaatgctaaaataccagttgattacccaaattattttggaaatctatccataatggaagtctacaacaaacacataaaacagattacactaagagctgagaaattcaaaggaactgaagattctgagagataaactgttcaagtcttagcaatgatactgcacttctctttgacaggttctgggcttaagttagaggccctactggttccaaaccatattccactgactttgcaagtaaaataaatttgattctgaaataggaaacaaaaaaaggagaaataaccgaatagtagaagaaaaactgtttgtaggaagacgatgcagatggaatgatgtggacattgagtaaccatgtcaataaaatatataaaccaaacttaaatttgtgaaataaggaagttggtacctttgttgttacagtgtataaaaacaatttcggaactgctgttgcaaaaagacatatatagttttgcttccttctggtgttaagctgtttatatttcagtttcagttttaacttctaagttgccttgtaattgggactgtgtttcagcatcacaaaaaccaaatatttattatggatgcatctgtatcagcaattaaaaaataaacaagtaaaagtgatactgta

SEQ ID NO: 123346 - DNA, 2936 bp, Homo sapiens
  Payload ID: 4220
  Gene Symbol: CXXC1
  Gene Name: CXXC finger protein 1
  Uniprot ID: Q9P0U4
  ENST ID: ENST00000285106
  CDS Start-End: 716-2686
tgaagtcggagacgacagaggaactggtttcctccgccccgcaaggcacacagcctgccgacgccccattaatacatgtggaaggggaaagagactgaatggaggaatgaatacaacttgatccaggtcgtgcttcggaagcggtcactttacctgtgaacctctctgcctgacaaacgggcaatgtacggaatcaaccaccaagatggcggcgcccgtgaagaatccgcaattaggtcgccgtcatatgtcgcctaggaacgtacggaattcgacccacgtacggaatcggattccaagatgacggcatctatgaggaagtcacgcagtaggtgcagccatgttgcctgtacgtcgaggccgtacaagcagccgccgtacggactctactgacaaggtggcggcgccctcgggaaagccacattagagcgcggccatgttcccggcgaacatatggattcggccaccatacggatacgataagcaagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcactcgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaa

SEQ ID NO: 123347 - DNA, 2280 bp, Homo sapiens
  Payload ID: 4220
  Gene Symbol: CXXC1
  Gene Name: CXXC finger protein 1
  Uniprot ID: Q9P0U4
  ENST ID: ENST00000412036
  CDS Start-End: 48-2030
gcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaaggtgatggagaggaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcactcgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggggccacacgactcttctgtgatgtgtataatcctcagagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaa

SEQ ID NO: 123348 - DNA, 838 bp, Homo sapiens
  Payload ID: 4220
  Gene Symbol: CXXC1
  Gene Name: CXXC finger protein 1
  ENST ID: ENST00000586837
  CDS Start-End: 146-838
gggaggggttcggcggtggaggtcggtcggttggcaacagtggggtctgtcggccgactcaggggtctgtggtgagccataaccggagtctgtggactgaacggcgggagtctatgggcagaatgatgaaccatctgggagttctatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtcc

SEQ ID NO: 123349 - DNA, 845 bp, Homo sapiens
  Payload ID: 4220
  Gene Symbol: CXXC1
  Gene Name: CXXC finger protein 1
  ENST ID: ENST00000591474
  CDS Start-End: 96-845
gcgcctttgcaaccgcctgggacgccgccgagtggtctgtgcaggttcgcgggtcgctggcgggggtcgtgagggagtgcgccgggagcggagatatgcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaaggtgatggagaggaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaag

SEQ ID NO: 123350 - DNA, 2242 bp, Homo sapiens
  Payload ID: 4220
  Gene Symbol: CXXC1
  Gene Name: CXXC finger protein 1
  ENST ID: ENST00000589940
  CDS Start-End: 63-1904
ggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggaatcgtacaagtacttcccttcctcgctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctgccctggatgagcgacacagaagagtccccattcctggaccccgcgctgcggaagagggcagtgaaagtgaagcatgtgaagcgtcgggagaagaagtctgagaagaagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaaccgcatctacgagatcctcccccagcgcatccagcagtggcagcagagcccttgcattgctgaagagcacggcaagaagctgctcgaacgcattcgccgagagcagcagagtgcccgcactcgccttcaggaaatggaacgccgattccatgagcttgaggccatcattctacgtgccaagcagcaggctgtgcgcgaggatgaggagagcaacgagggtgacagtgatgacacagacctgcagatcttctgtgtttcctgtgggcaccccatcaacccacgtgttgccttgcgccacatggagcgctgctacgccaagtatgagagccagacgtcctttgggtccatgtaccccacacgcattgaaggagcaaaacatactgtaagcggctccaggtgctgtgccccgagcactcacgggaccccaaagtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtgtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaa

SEQ ID NO: 123351 - DNA, 849 bp, Homo sapiens
  Payload ID: 4220
  Gene Symbol: CXXC1
  Gene Name: CXXC finger protein 1
  ENST ID: ENST00000589548
  CDS Start-End: 92-849
ctttgcaaccgcctgggacgccgccgagtggtctgtgcaggttcgcgggtcgctggcgggggtcgtgagggagtgcgccgggagcggagatatggagggagatggttcagacccagagcctccagatgccggggaggacagcaagtccgagaatggggagaatgcgcccatctactgcatctgccgcaaaccggacatcaactgcttcatgatcgggtgtgacaactgcaatgagtggttccatggggactgcatccggatcactgagaagatggccaaggccatccgggagtggtactgtcgggagtgcagagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccggctctcaccagtgacgccctcagagtccctgccaaggccccgccggccactgcccacccaacagcagccacagccatcacagaagttagggcgcatccgtgaagatgagggggcagtggc

SEQ ID NO: 123352 - DNA, 5565 bp, Homo sapiens
  Payload ID: 4221
  Gene Symbol: CXXC4
  Gene Name: CXXC finger protein 4
  ENST ID: ENST00000394767
  CDS Start-End: 452-1555
gcacacagcgactggagacggacggagagcaacgcgctgggagaggagagaccaccgacaacagacccgcgctctcacacatacactcacactcgactctttcctctccccccacctcctcctccttccacccccaccactaacaccatctcctcctccttctctctgcaacaagaaaaaaaagccatttacagttgtaacagttggaggataatgcaaaggaagacgctgcctgggaattcaccgtctgtggaaatgagccccagagaggaataaagcagccctcaccttgctctccccacccgaacccactttccccacccgcctcggcccccaccccaacaccaccatcactcccttccctcccccccacctttcccccttttccacccaggtgtcggaccaggcggtccccacttccaccctgcaccccttcttccccccctgcaccatgaacaccaatgtctgcgtggagcccgggccgagcccggaggccccgggcttgcccaaggaaagccacttgcccgagggggctctgaacagccttgtggattacaactcggaaatggagcgctaccgctcctttgccacctccttctacaagaccaacgggggcgccttcccacaggcggccaagatcgcgcgcatcaccacccccatcttccccagcagcgccgccgccgccgcggccgccgcgcgcatcggcatgtccccctggaactgcgacaacgcggccaccgccgccgccgccaccgccatgctctggggcagcggcgggggcgggggcggcggcggggggggtggcggcggcggcggcggcggcggaggcgggggcgggggtggtgggggcggcaggaaatcctcctccgccgccgcctcctcctccgcctcctcctcctcggcgatcctccccgccggcggtggcggcggcggcggcggcggcggcagcaggaccagcatgcaccaccgaaacgactcccagaggctggggaaagctggctgcccgccagagccgtcgttgcaaatggcaaatactaatttcctctccaccttatcccctgaacactgcagacctttggcgggggaatgcatgaacaagctcaaatgcggcgctgctgaagcagagataatgaatctccccgagcgcgtggggactttttccgctatcccggctttagggggcatctcattacctccaggggtcatcgtcatgacagcccttcactcccccgcagcagcctcagcagccgtcacagacagtgcgtttcaaattgccaatctggcagactgcccgcagaatcattcctcctcctcctcgtcctcctcagggggagctggcggagccaacccagccaagaagaagaggaaaaggtgtggggtctgcgtgccctgcaagaggctcatcaactgtggcgtctgcagcagttgcaggaaccgcaaaacgggacaccagatctgcaaatttagaaaatgtgaagagctaaagaaaaaacctggcacttcactagagagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttcaaaaaaaaaaaaaaagaggaaaagaaaagaaaaagacataaaaataatgtgagagcttggagaattggccagtctatttactttcaatacgctgattctttctttgatgtaatttagctatagtagtgaagttgttgtctattttgaaagtggctgtaaaaaataagtttgggtaaacccctgctgtaaaatcatgtatctttgcaaagtacatatctatacttcattttcaaatatatgtgtttcagtactgtaaactgtacagatagcagcttgtattttgtgtgtttagacacaaggagacaatcatgtctgagcatctatggagattaacagtttgtacacaacagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttaggaggggaaaatttataactgacattttttccccagcccaatatgggctgtatacgttttattgtttcttaatttttttcttattttttctgtaggaaaaaatcttaataaaaactaccccaatgttttaacttcatgtatgatattaaatgggtagttttaacacttgaatatgttgagggcttctgccttgaggcagggcttgatatatttttaatttacaaagaattaaacatattcataaaagtgaggcattttatctctttttattttcttttctcatagccacccagttggactagtggtcttcccctggtccttcagtaaaatgctccattgctgccatttccattgttgttacttgatgctttcattcctgagaaggcagggctacagtctctggaatttcataaatgcatgacatacccctccccccacaacctacacacaaaggatctaatgcttcatagaacctgtgctaccttttcatgttggagttggttttcttatcacagtcagggttcttaaggccgtcccatcaggacaaatatttaccttccattttatttctgtttgtcccaattataaagactattttcagtttcaggagtagaacagggtttagcaaaaatatgtagagtatcaaagttacctactgcaactttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggtggacaaagcatgcacacatgccaatttgaaaatcaagtgtgacttacctcacgtagagtatgaatacatggtccacagttatggtcaacaagcgttttcaagaaaaactcatgatgtgttacacccatccatatttagagatgagaattaaatgattacaagctaaaatgtgctgtatactgtattaattttgagatagctttctacttgatgtatatttctttgagggtttctatctagttagaatttcagcttctgctgtgggaccaatgagagctgtatgagtttttttttttttttccttttccattattttattttttgttttttgtttaccaatttgctaattaattacaagtaagtgaaaacttactttcacacttgaatgataagcttgccttgctctttggaaaatgatgattgttattacagaagtgaaacaaacttctattcaggctacagtaggcatacaataacctaaagatctcatagaagtatactgagagtctaaaatacattctagtagtgcatgtcttggtgtgcttttgtttgtttgctttctaaaagaactaatgaatctgtatattgtaaactgtggtgttttacatgtcaattcatttttttaatgaaagaaaatttgttgattactgaaatgagaaagtgtagcttttcattaattctcttatgttttttattcttgatattgttcttttataccacccactttttaatgtttttggttaaactccatttatataatgtaggatgcatataaagttctcattggtgatgttgaagaaagagatgactcttctggcctttctctagttttcttcctcatatgtccctgtactgagaacttctaaagcttatcattataaacctaaggcagtgatttgaaagtttacatttttcatgattttcaaataccaatgaaatgtaacttttaaatattcctcactgtgtgttttatattcactgtcaagaaaattcagaatgtagattgtgtggacagctatacacaacttaataattatatatcagataaactgaataaaaaactttgtaagagtggtctacgcacacaggatcttgtcctccctaggcgtggatagagagatgccataatctgccagcatttggggagatcatggtaaatacttgaggcgttgatacatagtgcagtgagccaatttccttttcagttgtcactcagcaccataacatcacgaagaacatcattaatgcaaacctctcactaagccttcagaccaaagtggctttctgatggactctgcctgtctgtctacaagtggagtcagattcaaagtagaaatgtatccatccttgggaaagaaaataggaagtcttcccccactgtaggagtatataaaaatgtctcctggttgcttaattcccaacactcaatttccttcttctaaacacatttataaggagcaagagatggtgcacttattatgaattaatattaagcaatcactaaaagaaaggaatattctcttcctttcaatcagaaaccctgatatgtaagttgtgcaattaatgctaaagcatataaagtctttaagctgataagtatctgtaatcaaataatgaaaaaaggaaagcagttaaatgaacacactattcagggtcaaatatgttcagcaaaaagccgtagcgggtctttgatcatggttagattcacagtgatatcaaacagttggttctcatgtaacagctaaatgtttcagtttttttttttttattaaatttggcatttcacactgagatctgtattcctagtgaataaaagacagctactatattaggagggattccattttcacaattgcaaaacagatatttcaggaacatgggccacaaaatgtactcctttcacagtgttctcctcttctgaactgtgcagttatctattaaattttctaatagatatttgtgtaaggtgtatgtatgcttgtgcaattatttaaaaaacggttttggaaaacagtgtatttattaaagaaaattacttatggggcatgtacaaaactgtaaaaaaaaaaaaaaagtaaaaaaaatcacattcaatttgcccagtaaagttgtttttgtgaaatttctgtgttgttgaataaaggactttagtactc

SEQ ID NO: 123353 - DNA, 2658 bp, Homo sapiens
  Payload ID: 4222
  Gene Symbol: CXXC5
  Gene Name: CXXC finger protein 5
  Uniprot ID: Q7LFL8
  ENST ID: ENST00000302517
  CDS Start-End: 715-1683
gttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaa

SEQ ID NO: 123354 - DNA, 506 bp, Homo sapiens
  Payload ID: 4222
  Gene Symbol: CXXC5
  Gene Name: CXXC finger protein 5
  ENST ID: ENST00000503511
  CDS Start-End: 257-506
attccaggccctgggcatctccaagtgccccaggtgggggcactctcctggggtctgtgacagcttgcccccaaccacggagaggtgacaggcacgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactctt

SEQ ID NO: 123355 - DNA, 442 bp, Homo sapiens
  Payload ID: 4222
  Gene Symbol: CXXC5
  Gene Name: CXXC finger protein 5
  ENST ID: ENST00000511591
  CDS Start-End: 419-442
acaggatctcactctgtcatccaggctggaatgcagtggcatgattataactcactgcatcctcaacctcctgggctcaagcagtcctcccacctcagcctcctgagtagctaggactacaggcatgtaccaccacacctggttaacttttgtattttttgcagagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcc

SEQ ID NO: 123356 - DNA, 568 bp, Homo sapiens
  Payload ID: 4222
  Gene Symbol: CXXC5
  Gene Name: CXXC finger protein 5
  ENST ID: ENST00000504944
  CDS Start-End: 262-568
gcgcacctgagctggggggcgcggccaaattctccctcccggtcctcgaagcttctggccccgctctagagggggcagaaagatagcagatttccccggagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctg

SEQ ID NO: 123357 - DNA, 558 bp, Homo sapiens
  Payload ID: 4222
  Gene Symbol: CXXC5
  Gene Name: CXXC finger protein 5
  ENST ID: ENST00000512816
  CDS Start-End: 339-558
gatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgc

SEQ ID NO: 123358 - DNA, 900 bp, Homo sapiens
  Payload ID: 4222
  Gene Symbol: CXXC5
  Gene Name: CXXC finger protein 5
  ENST ID: ENST00000502716
  CDS Start-End: 358-900
gcttagcattccaggccctgggcatctccaagtgccccaggtgggggcactctcctggggtctgtgacagcttgcccccaaccacggagaggtgacaggcacgagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccg

SEQ ID NO: 123359 - DNA, 777 bp, Homo sapiens
  Payload ID: 4222
  Gene Symbol: CXXC5
  Gene Name: CXXC finger protein 5
  ENST ID: ENST00000504844
  CDS Start-End: 295-777
gggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacg

SEQ ID NO: 123360 - DNA, 581 bp, Homo sapiens
  Payload ID: 4222
  Gene Symbol: CXXC5
  Gene Name: CXXC finger protein 5
  ENST ID: ENST00000502336
  CDS Start-End: 340-581
cccccggggttcggtgcgcggccggggccggagttcgctgcaagtcggcggaaagtttggctgcgcgggttcccccgaagttcagagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctccca

SEQ ID NO: 123361 - DNA, 503 bp, Homo sapiens
  Payload ID: 4222
  Gene Symbol: CXXC5
  Gene Name: CXXC finger protein 5
  ENST ID: ENST00000502295
  CDS Start-End: 298-503
actgcgttttcttcgcctcgcagaggaaggtcggccttgcacaaatccgcccccacgaatcccaaagaattggagaaaacttccactttgggattatatgcagttgggattatatgagcccggggcttgcaccatggagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccct

SEQ ID NO: 123362 - DNA, 472 bp, Homo sapiens
  Payload ID: 4222
  Gene Symbol: CXXC5
  Gene Name: CXXC finger protein 5
  ENST ID: ENST00000507139
  CDS Start-End: 440-472
cccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgcc

SEQ ID NO: 123363 - DNA, 1892 bp, Homo sapiens
  Payload ID: 4222
  Gene Symbol: CXXC5
  Gene Name: CXXC finger protein 5
  Uniprot ID: Q7LFL8
  ENST ID: ENST00000511048
  CDS Start-End: 238-1206
gttcggtgcgcggccggggccggagttcgctgcaagtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaa

SEQ ID NO: 123364 - DNA, 542 bp, Homo sapiens
  Payload ID: 4222
  Gene Symbol: CXXC5
  Gene Name: CXXC finger protein 5
  ENST ID: ENST00000509238
  CDS Start-End: 248-542
aaagccttccccaggggccttgtggtgccctccaccctgtcctgagctgccgctgcgggggtggcagatgctgtttcatcggtcgagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcg

SEQ ID NO: 123365 - DNA, 878 bp, Homo sapiens
  Payload ID: 4222
  Gene Symbol: CXXC5
  Gene Name: CXXC finger protein 5
  ENST ID: ENST00000520967
  CDS Start-End: 466-878
cggggttcggtgcgcggccggggccggagttcgctgcaagtcggcggaaagtttggctgcgcgggttcccccgaagttcagggtcctcttgcctgcccagcttgggctgatggagacagatgtaattatggaattttgcttgggaaattaatttgaaaaagttaattaattggtggttccggaggtggcgggctccacgcccggccagtcttgctgacgtcagtgctgacccactggagacgtgcagcttccgggcaagctgggcagagggaccccggtgacctggctgggcagccctggaacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaag

SEQ ID NO: 123366 - DNA, 810 bp, Homo sapiens
  Payload ID: 4222
  Gene Symbol: CXXC5
  Gene Name: CXXC finger protein 5
  ENST ID: ENST00000511457
  CDS Start-End: 221-810
aggtgggggcactctcctggggtctgtgacagcttgcccccaaccacggagaggtgacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggc

SEQ ID NO: 123367 - DNA, 651 bp, Homo sapiens
  Payload ID: 4223
  Gene Symbol: CNBD1
  Gene Name: cyclic nucleotide binding domain containing 1
  ENST ID: ENST00000521593
  CDS Start-End: 1-485
ctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgaattagacccagtgaccaagcaacttatgctccaaacagctaaaccaacttttggccatctgacagatgaggatgtcaaaaatgaatatttgaaaaaggaacaacaaaaagaatggaaagatttcaagattgcatcatggacaaaagaaataacagatttcatttgtctctatgaaaaacatcaagataattttaccttaccaaaaattgcacatttagagagaatcaccaaaagaattaagaataacagcatccttattcacttggaatgagcaagaaaattcactggtctagtaacaaaagaggatacagcaagaagacaaaaatctacaagctaggaagacagccctcaccagaatctgaccatgctggcaacttgatttcagacttcccagcctccagaacgagaaaaaaaaaaaaaaatctgttgtttaggtc

SEQ ID NO: 123368 - DNA, 1594 bp, Homo sapiens
  Payload ID: 4223
  Gene Symbol: CNBD1
  Gene Name: cyclic nucleotide binding domain containing 1
  Uniprot ID: Q8NA66
  ENST ID: ENST00000518476
  CDS Start-End: 52-1362
atttgcctctcaagcagcctctggtcatctatctgcctttgagccatcaagatgccgatgtcttctcttccagcagctattttgtctcacatgacagctattaacaatgtgcctcctcctccacttcacagtataccaaacttgaaaaagtctaagcacattaattatggccagttgaatgcattatgccacattagaggacaacacagccggagtatgagcaatatcttatcagctcacgatacatttatgaagcaatatcctaaagtattcctgcaccaaaaacccagacttcctaaacttttcaaacaggaggaacaaagggaactcaatgaaggcaaagaggaaagtcaacatcaacaacctgatgattctaacaatatagctgtccatgttcagagagcacatggtggccatattttatatagaccaaaaagagccacagagaaatttgaagaattcctagctatcttaaagaaattgcccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatgcttagcaaatggagtacctttgggactctggaagttatgcctcagaatgaatcggaaacacagatgttctcggtggtgacagaagacgattgtgaaattcttaaaatcccagcaaagggatatgcaaagataaaggaggaaaaaataaaacttgaaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgtggcctagatctagaaacaacctcagtgaacattaattaagaaagtattgactaaataatggaataattgcattctggaatactatcaaactaccagcaatgaatttggtctattgtgactacatatcctggattccccaggaaagtcccactttcgaattgcctttcaaacacagtttttattagcagtctttcttggtttggatactaaaataaatatagttatcattgcttgattta

SEQ ID NO: 123369 - DNA, 659 bp, Homo sapiens
  Payload ID: 4223
  Gene Symbol: CNBD1
  Gene Name: cyclic nucleotide binding domain containing 1
  ENST ID: ENST00000523299
  CDS Start-End: 1-623
aaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgaattagacccagtgaccaagcaacttatgctccaaacagctaaaccaacttttggccatctgacagatgaggatgtcaaaaatgaatatttgaaaaaggaacaacaaaaagaatggaaagatttcaaggataagactgtgaaaaactccttgtattataaaggaattattccaggctttggaaaatgggaccattactgcaccagcattcctaggaacctcaaggacactctagtaaattattaaaagtaccagctcgtaagaagctggggatttcagcat

SEQ ID NO: 123370 - DNA, 876 bp, Homo sapiens
  Payload ID: 4223
  Gene Symbol: CNBD1
  Gene Name: cyclic nucleotide binding domain containing 1
  ENST ID: ENST00000620844
  CDS Start-End: 1-876
cccattcacaggacgccatatgaacacaaaactgtgtggaagttcctgaaaacaattccagatttaacctttcagctaaatgataagcatctgaaaacacttagtaagactgtcttttccgaaacctggttgaaaggcagcacagtggttgcaaatgatggattttatgtaatactgaaaggcctagctcgacctcaaacaaacgtgtataaaaatctgattgaaggaagtgattcaccagactcgttcatatctcagagtttccacagcttcatttggagtgaagaattcaaaaactctacacttgctgagatgtacctaccttcatatgactcaatgcttagcaaatggagtacctttgggactctggaagttatgcctcagaatgaatcggaaacacagatgttctcggtggtgacagaagacgattgtgaaattcttaaaatcccagcaaagggatatgcaaagataaaggaggaaaaaataaaacttgaaaatatgcaaaagttgaaattaatccgtatgtgtccttattatgaggaatggcctactttatccatatatgagctaattgcactccttaaatggaaaaaatttcctccaggtcatgtgatagtggaaagtggaaatataatttcttttgtgggttatattaactctggatgctgtaacatttatagaagtattataggatttgtgaaactacgatcaaataaagtgaaaagatctcaaaaacttgtttatatggggaaacttaaggagaaggagtcctttggtgagattagcgtccttcttcaagttcctttcacgtgcacaatcattaccaaaaaagaagttgagatggcaatcattgaagataaggacctatttgatgca

SEQ ID NO: 123371 - DNA, 1927 bp, Homo sapiens
  Payload ID: 4224
  Gene Symbol: CNBD2
  Gene Name: cyclic nucleotide binding domain containing 2
  Uniprot ID: Q96M20
  ENST ID: ENST00000349339
  CDS Start-End: 157-1875
agctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 123372 - DNA, 1956 bp, Homo sapiens
  Payload ID: 4224
  Gene Symbol: CNBD2
  Gene Name: cyclic nucleotide binding domain containing 2
  Uniprot ID: Q96M20
  ENST ID: ENST00000373973
  CDS Start-End: 174-1904
agagcagggcttccagtagctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttgggtcttcaccaggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 123373 - DNA, 1722 bp, Homo sapiens
  Payload ID: 4224
  Gene Symbol: CNBD2
  Gene Name: cyclic nucleotide binding domain containing 2
  Uniprot ID: Q96M20
  ENST ID: ENST00000538900
  CDS Start-End: 141-1412
ggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttgtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtcctt

SEQ ID NO: 123374 - DNA, 1426 bp, Homo sapiens
  Payload ID: 4224
  Gene Symbol: CNBD2
  Gene Name: cyclic nucleotide binding domain containing 2
  ENST ID: ENST00000463258
  CDS Start-End: 141-575
ggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctccccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttgtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaaacctcgttatcctatttttatggcaccccagaaatacctccccccattgaggattgtccaagccatcaaagcacctcggtacaaaatccgagaactcttggcttagtgtaagagcacaggggtcctt

SEQ ID NO: 123375 - DNA, 662 bp, Homo sapiens
  Payload ID: 4224
  Gene Symbol: CNBD2
  Gene Name: cyclic nucleotide binding domain containing 2
  ENST ID: ENST00000614708
  CDS Start-End: 1-77
tagacttcaagtcccggaccttatccgtgcgccgcttcggtttgcaggtgacctttgcgtgcgggcgccccttctgattgaccctgatgagctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggcctcctgagttgactcagctcttgcaacgtagctagttgataaccctcgaaatatagcgaattgagatgtgctatattgtaaaatacgggacttagtacgaaaaaactgatgtaaaaattatctcaatactttttaatactgattacatgttggaatataatgttttgcatatattgggtcaaataaaaatgttattaatttca

SEQ ID NO: 123376 - DNA, 559 bp, Homo sapiens
  Payload ID: 4224
  Gene Symbol: CNBD2
  Gene Name: cyclic nucleotide binding domain containing 2
  ENST ID: ENST00000622112
  CDS Start-End: 17-559
agcgttctcgagtcgcatgaggcggctgctgccctcgcggtgcgggagggcgagctgcgcgtggcctgggctccttccgaatggtggcgcctctgagcgccagttcgaggaggagtcggaggaggagcctgaatgtttggagatagacttcaagtcccggaccttatccgtgcgccgcttcggtttgcagattgagaaaccaagatgtcagaagatgaaggattggtccaaaataagaaagctaggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagag

SEQ ID NO: 123377 - DNA, 2531 bp, Homo sapiens
  Payload ID: 4224
  Gene Symbol: CNBD2
  Gene Name: cyclic nucleotide binding domain containing 2
  ENST ID: ENST00000489667
  CDS Start-End: 153-455
gatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggatgtaagcagttgggctcagcaggattatgagggctcaaagaagcccaataaattgcatcccacttcctggcctaagctcagaactgagaaagaagacaaaaggaaaagcagatgagagacccaatggtcacttttattaatggccatacttctgttggagagggtgacttacatcatcaaccaagaggtttacctaatactgaaccccagatttagacagccttacatgcctagccacaggcaacgctggaccaaggcaggctccactgcaacagcaggcctgctgccaaaactcatggcagggaaaggtggagcaaaatatgggctgagagggaaggagacaatcatgcctagtttttctctttccaaattcatcaaagagtttaagtcactcctcaatgtaaaaggagagaggccagtagtgttctactaatacacctccctccatgtggaaagaaaccttgggagtagagaggtggtctccatttcaatggtgatcaaaagagccagaagcaatccaggaatcacaataaccagggttttctaaatgcccacacgctctctctattcgcgtctctactttctttcctacacccctacttcggtgcaggggcattttcagggctttgttcactgcggtgaccatgtttcttttatttttttgagacggagtcttgctctgttgcccaggctggagtgcagtggcgcgtcttggctcactgcaagctccacctcccgggttcacaccattctcctgcctcagcctccctagtagctgggactacaggcacccgccaccacacccagctaattttttgtatttttagtagagacggggtttcaccttgttagccaggatggtcttgatctcttgacctcgtgatccacctgcctcggcctcccaaagtgctgggattacaggcgtgagccaccgtgcctggcctggtgaccaggtttctagatttcctagaaggtcccaatttaaaatattttatcccagtggtagatcatgtgcccttctttagctcagaaaagttggtcacccttctgctaacttgttctagttccccagaggtatcttcattgctactgggtgtgttgctcagggcttcaaagtttccccagcaatcacctggacaaatcctgcccatttttctgttgtttcaggaatgactagagccagtccccactcctctgcatctagtgattcactccaagaaatttccctaaagggcttctgacagatagtggccaaagaaagggggatacggggctggtgatgggggaaggaaaggcagccttaaactggtttctgaggggccagcaggtaatataactagtgtgtatgtagctgagtttaagatacagcaggccagctggagaggaaagatacacctcatctaaagacattcagatacaaatattatattttaagaccctgtgctggccaaaccaaacaaggctgcagccctgtggttgggctgagatgaaaaacgaatggagtagaagaactgtaaccaaaagactcaggttagctctcaggaaggacctcctgactctcagggtggcatgtaatggtgatgcaatgggccctggagatcagagggctttggttaccagaagacgtggcctgatgcatggggcagttggaagctaagatgcagagtcacttgttgtcaggggaatgtgaggctaagcctaaccacattggccagccagagtggcttgagcagagcagaagcctctcaagggcagcctataagggtcatagggttgtcaggcggagcactgggcggctggagtgcaggatcaggtggggagccctagactgcttcagtagatgtgtgaatctggatgtttctgagcactgcctctttccttcagtagtctccctgagaagcaccacatggctatgcaaaggataaacacgttgtgggggcgagacgggtctgagtctaaggaacaaatgacatgtggcttgaggccacactccagacacggaattgggtttgctgaaagccttgagttggggtctcagctagaccactgacttgctgtgtgatccttgggcaagttccttcaccatctcagtcctacatggagcttaataaaacctgctttgtcctgatgactaaatggagtaaggcagggaggatacactgtgcttggctcattaaagacatttaacaaa

SEQ ID NO: 123378 - DNA, 2627 bp, Homo sapiens
  Payload ID: 4225
  Gene Symbol: CNGA1
  Gene Name: cyclic nucleotide gated channel alpha 1
  Uniprot ID: P29973
  ENST ID: ENST00000358519
  CDS Start-End: 113-2185
agggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgc

SEQ ID NO: 123379 - DNA, 2867 bp, Homo sapiens
  Payload ID: 4225
  Gene Symbol: CNGA1
  Gene Name: cyclic nucleotide gated channel alpha 1
  Uniprot ID: P29973
  ENST ID: ENST00000402813
  CDS Start-End: 144-2423
aaaaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgcagtggcgcgatctcggctcactgcagtcttcacctcccagattcaagcgatttccagctaatttttgtatttttagtagagatgggatttcaccatgttggccaagctggacttgaactcctgatctcaagtgatctgcccacctcagcctcccaaagtgctggtattacagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaa

SEQ ID NO: 123380 - DNA, 2746 bp, Homo sapiens
  Payload ID: 4225
  Gene Symbol: CNGA1
  Gene Name: cyclic nucleotide gated channel alpha 1
  Uniprot ID: P29973
  ENST ID: ENST00000420489
  CDS Start-End: 267-2339
tttttcctgcttcttgaatggtagagagcagtctatagccagagactcgtccctagctcgagctgagctttcgcttgccgtccaccactgcccaccactgtcgtttgctgccatcgcagacctgctgctgacttccatccctctggatccggcaagggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacattttta

SEQ ID NO: 123381 - DNA, 405 bp, Homo sapiens
  Payload ID: 4225
  Gene Symbol: CNGA1
  Gene Name: cyclic nucleotide gated channel alpha 1
  ENST ID: ENST00000514520
  CDS Start-End: 107-405
tattagcagcatgaggacagactaatacatagggtgaaacttttgattatatatgtaaatatataaaaatagcctttccactaataagacttctttctcctcagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggacca

SEQ ID NO: 123382 - DNA, 589 bp, Homo sapiens
  Payload ID: 4225
  Gene Symbol: CNGA1
  Gene Name: cyclic nucleotide gated channel alpha 1
  ENST ID: ENST00000513178
  CDS Start-End: 293-589
cgagccctgctgcccggggcttgttgcgaattctcagggcccccgcaggcctgggagcggcctgtgataactggtgtatctggcaggagtagcagctgccccttggcgcgactgctggagccgcgaactagagaaacacagacacgcctcatagagcaacagcgtctctcggagcgtggagcccgccaagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggac

SEQ ID NO: 123383 - DNA, 543 bp, Homo sapiens
  Payload ID: 4225
  Gene Symbol: CNGA1
  Gene Name: cyclic nucleotide gated channel alpha 1
  ENST ID: ENST00000504722
  CDS Start-End: 159-543
tttttcctgcttcttgaatggtagagagcagtctatagccagagactcgtccctagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaaga

SEQ ID NO: 123384 - DNA, 2837 bp, Homo sapiens
  Payload ID: 4225
  Gene Symbol: CNGA1
  Gene Name: cyclic nucleotide gated channel alpha 1
  Uniprot ID: P29973
  ENST ID: ENST00000514170
  CDS Start-End: 321-2393
tggcaggagtagcagctgccccttggcgcgactgctggagccgcgaactagagaaacacagacacgcctcatagagcaacagcgtctctcggagcgtggagcccgccaagctcgagctgagctttcgcttgccgtccaccactgcccaccactgtcgtttgctgccatcgcagacctgctgctgacttccatccctctggatccggcaagggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaa

SEQ ID NO: 123385 - DNA, 2722 bp, Homo sapiens
  Payload ID: 4225
  Gene Symbol: CNGA1
  Gene Name: cyclic nucleotide gated channel alpha 1
  Uniprot ID: P29973
  ENST ID: ENST00000544810
  CDS Start-End: 1-2280
atggagtctcgctcttcgcccaggctggagtgcagtggcgcgatctcggctcactgcagtcttcacctcccagattcaagcgatttccagctaatttttgtatttttagtagagatgggatttcaccatgttggccaagctggacttgaactcctgatctcaagtgatctgcccacctcagcctcccaaagtgctggtattacagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgc

SEQ ID NO: 123386 - DNA, 2834 bp, Homo sapiens
  Payload ID: 4226
  Gene Symbol: CNGA2
  Gene Name: cyclic nucleotide gated channel alpha 2
  Uniprot ID: Q16280
  ENST ID: ENST00000329903
  CDS Start-End: 34-2028
ctggcagataagtgctctggttgtacatggaggatgaccgaaaaaaccaatggtgtgaagagctccccagccaataatcacaaccatcatgcacctcctgccatcaaggccaatggcaaagatgaccacaggacaagcagcaggccacactctgcagctgacgatgacacctcctcagaactgcagaggctggcagacgtggatgccccacagcagggaaggagtggcttccgcaggatagttcgcctggtggggatcatcagagaatgggccaacaagaatttccgagaggaggaacctaggcctgactcattcctcgagcgttttcgtgggcctgaactccagactgtgaccacacaggagggggatggcaaaggcgacaaggatggcgaggacaaaggcaccaagaagaaatttgaactatttgtcttggacccagctggggattggtactactgctggctatttgtcattgccatgcccgtcctttacaactggtgcctgctggtggccagagcctgcttcagtgacctacagaaaggctactacctggtgtggctggtgctggattatgtctcagatgtggtctacattgcggacctcttcatccgattgcgcacaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccagcatggaggtcgacgtgcaggagaagctagggcagctggagaccaacatggaaaccttgtacactcgctttggccgcctgctggctgagtacacgggggcccagcagaagctcaagcagcgcatcacagttctggaaaccaagatgaaacagaacaatgaagatgactacctgtctgatgggatgaacagccctgagctggctgctgctgacgagccataagacctggggcccaactgcctctccagcattggccttggccttgatcccagaagctagaggagctatttagatctccggatttacatgcattaccctcatgttccctgaattctcccaaaagcctctctgaccctgggtttttggcctaaacatccaagattccgcctccaagtttagcccaagtttgtggagagtacagactgcgttggctgggcttccgagagcttcggcctgcctaagtctgaggaagggagaagggggcagctgtctgccaggagtctggctcttttgctcatagcgacccctcccttggttctggcccccgctttttctaacatgtcttctgaatgcttcctttttccctgcacacgcatgtacttcgagcaccgactatagacatttagatcaggtacccagtgtctgtctcccacgacaggccaagggatgtgatagtgttgttgggagggggtagaagggtgcccactcagggttattcctcccccatcagatgctccagctcctgctctgtagattgatctgtctgtctgctagccaggatgggatctctgcagtcttctgtggaccaaggagatagacccggcttctggtccattccagggcagggagtgaggagcaaggcaactggcatttgtccacctggagacagaggtagctggcagctctggccatccctcccctatgaagagcattcctaaagaggccctgaaaactgctggtggtggggagactcttcaagttaatatctgcattagaggcacctatgagttaaaaaattcctttgaact

SEQ ID NO: 123387 - DNA, 3470 bp, Homo sapiens
  Payload ID: 4227
  Gene Symbol: CNGA3
  Gene Name: cyclic nucleotide gated channel alpha 3
  Uniprot ID: Q16281
  ENST ID: ENST00000272602
  CDS Start-End: 40-2124
agcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaata

SEQ ID NO: 123388 - DNA, 3841 bp, Homo sapiens
  Payload ID: 4227
  Gene Symbol: CNGA3
  Gene Name: cyclic nucleotide gated channel alpha 3
  Uniprot ID: Q16281
  ENST ID: ENST00000393504
  CDS Start-End: 418-2502
gcttactcatccagtgtggattacactaccagcaaaacatcccaggaaggagtccagggtggccgcccacagttaggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcaggcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggattt

SEQ ID NO: 123389 - DNA, 2615 bp, Homo sapiens
  Payload ID: 4227
  Gene Symbol: CNGA3
  Gene Name: cyclic nucleotide gated channel alpha 3
  Uniprot ID: Q16281
  ENST ID: ENST00000409937
  CDS Start-End: 142-2238
gaagatgaaattcagtaggcgagaagtgttggaaccaaaatcctcgttctggagtcattttatggaagcagctgctttggcttgaaatgagcccactcgtcaagtgaggagacatcgtcagtgctgcagccggggatcgccatggagaccagaggactggctgactccgggcagggctccttcaccggccaggggatcgccaggtttggaagaattcagaaaaaaagccaaccggagaaggtggtaagagcagccagccgtgggagacctttgattgggtggacacagtggtgtgctgaggatggtggtgatgagtctgaaatggctctggcagggtctcccgggtgctcgtctggaccccagggcaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtc

SEQ ID NO: 123390 - DNA, 2504 bp, Homo sapiens
  Payload ID: 4227
  Gene Symbol: CNGA3
  Gene Name: cyclic nucleotide gated channel alpha 3
  Uniprot ID: Q16281
  ENST ID: ENST00000436404
  CDS Start-End: 385-2415
aaaacatcccaggaaggagtccagggtggccgcccacagttaggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcaggcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaaggaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcaggg

SEQ ID NO: 123391 - DNA, 1863 bp, Homo sapiens
  Payload ID: 4228
  Gene Symbol: CNGA4
  Gene Name: cyclic nucleotide gated channel alpha 4
  Uniprot ID: Q8IV77
  ENST ID: ENST00000379936
  CDS Start-End: 116-1843
agaagcccaacagcagcctccttcaggcagtcaggcactagtgcccaactccagaagtcccctacaggcagagagggtgtggacatctcacaccccagcaccagaccacagaaccatgagccaggacaccaaagtgaagacaacagagtccagtcccccagccccatccaaggccaggaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacaggattcttggaacagggcatcctggtggtggacaagggtaggatctcgagtcgctacgttcgcacctggagtttcttcttggacctggcttccctgatgcccacagatgtggtctacgtgcggctgggcccgcacacacccaccctgaggctgaaccgctttctccgcgcgccccgcctcttcgaggccttcgaccgcacagagacccgcacagcttacccaaatgcctttcgcattgccaagctgatgctttacatttttgtcgtcatccattggaacagctgcctatactttgccctatcccggtacctgggcttcgggcgtgacgcatgggtgtacccggaccccgcgcagcctggctttgagcgcctgcggcgccagtacctctatagcttttacttctccacgctgatactgactacagtgggcgatacaccgccgccagccagggaagaagagtacctcttcatggtgggcgacttcctgctggccgtcatgggtttcgccaccatcatgggtagcatgagctctgtcatctacaacatgaacactgcagatgcggctttctacccagatcatgcactggtgaagaagtacatgaagctgcagcacgtcaaccgcaagctggagcggcgagttattgactggtatcagcacctgcagatcaacaagaagatgaccaacgaggtagccatcttacagcacttgcctgagcggctgcgggcagaagtggctgtgtctgtgcacctgtccactctgagccgggtgcagatctttcagaactgtgaggccagcctgctggaggagctggtgctgaagctgcagccccagacctactcaccaggtgaatatgtatgccgcaaaggagacattggccaagagatgtacatcatccgagagggtcaactggccgtggtggcagatgatggtatcacacagtatgctgtgctcggtgcagggctctactttggggagatcagcatcatcaacatcaaagggaacatgtctgggaaccgccgcacagccaacatcaagagcctaggttattcagacctattctgcctgagcaaggaggacctgcgggaggtgctgagcgagtatccacaagcacagaccatcatggaggagaaaggacgtgagatcctgctgaaaatgaacaagttggacgtgaatgctgaggcagctgagatcgccctgcaggaggccacagagtcccggctacgaggcctagaccagcagctggatgatctacagaccaagtttgctcgcctcctggctgagctggagtccagcgcacttaagattgcttaccgcattgaacggctggagtggcagactcgagagtggccaatgcccgaggacctggctgaggctgatgacgagggtgagcctgaggagggaacttccaaagatgaagagggcagggccagccaggagggacccccaggtccagagtgaccccatccccatccccagga

SEQ ID NO: 123392 - DNA, 936 bp, Homo sapiens
  Payload ID: 4228
  Gene Symbol: CNGA4
  Gene Name: cyclic nucleotide gated channel alpha 4
  ENST ID: ENST00000533426
  CDS Start-End: 152-829
gcttgtttcctggcaacggctaaacgcaagggcggggtcgccgacggctatccgagggaggagcaccgcctctcctcttggttccgtcccttcgaagttgctgcctgtcctggacccatctggggattactactactggtggctgaacacaatggtcttcccagtcatgtataacctcatcatcctcgtgtgcagagcctgcttccccgacttgcagcacggttatctggtggcctggttggtgctggactacacgagtgacctgctatacctactagacatggtggtgcgcttccacacagatcatgcactggtgaagaagtacatgaagctgcagcacgtcaaccgcaagctggagcggcgagttattgactggtatcagcacctgcagatcaacaagaagatgaccaacgaggtagccatcttacagcacttgcctgagcggctgcgggcagaagtggctgtgtctgtgcacctgtccactctgagccgggtgcagatctttcagaactgtgaggccagcctgctggaggagctggtgctgaagctgcagccccagacctactcaccaggtgaatatgtatgccgcaaaggagacattggccaagagatgtacatcatccgagagggtcaactggccgtggtggcagatgatggtatcacacagtatgctgtgctcggtgcagggctctactttggggagatcagcatcatcaacatcaaaggtgggtatcccagtatttgttccagggacaaggatgggtggggtaggggggaacagcagagcccagtgctgggaccagatagtacttcaggcctaaacttctgattgaggaaacctggcccttctctgagtcactagatggctcaggagaaaaacaacacatagaggatccattccctgagaagaagctgagccaaggccagtgaacaggg

SEQ ID NO: 123393 - DNA, 5641 bp, Homo sapiens
  Payload ID: 4229
  Gene Symbol: CNGB1
  Gene Name: cyclic nucleotide gated channel beta 1
  Uniprot ID: Q14028
  ENST ID: ENST00000251102
  CDS Start-End: 62-3817
ctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgccggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctgcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaacaaaaacaaaaacaaacaaaaaaacaatagccaggcgtgatggtgtgcacctgtagtcccagctactggagaggttgaggcaggaggatggcttgagcccaggagtttctggctgcagtgagctggacacagtgagaccctgtctcaaaaaaactaaaagatagccctgcacagtggttcacatctgcaatcccagcagtttgggaagctgagatgggaggattgtttgagaccaggagttcaagaccagcctgggcaacatattgagaccccatctctacaaaacagcagcagaaacaaaagcaaacaacaacaacgtacacaaacaaaaaaacaaagaaaggagggcagcccgagctgttcagctgagaattgccatggttctgagctgagcttgggacgcggttttcctttgcgggcaatcacagtagggggctagatgcccattaaggtagttagtgcttatcttccccagactctattcaattccaatgcaatgccattatctcagaacagatagaagggaaatggacttactggccaggagctgctagcgtttctgcctctgccaggaggaacagcccggtaggagcatcctctgcctgtcatcctgagaaaccccattcgccagcagggatcagtccgttactcacttttgacactctcgctgtagagatggtggcagcaacttcaattaatcctagaaaatgaaatctcccagctgatgacagcacttacattccctaaagctttccagatcgtgtcatgttgcttttatgattcagacaaaaaaaaaaaaagaaaaaagaaaaaaaaagaaaaaagggtcattcagggaatgaatatttatcaagaggattttatttgcataccaaatggctcttgggggagtgagtgattaaaaacaaaatctagtattctagtattaggccatttgtttccacctgcaacagtgaacataaaggacctggaattccaataggtcctgcccattttatataaaattacaggaaaatgtgagctgctcagaggcctttgaaggtttgcaaatgtctgtatgtatttgtccatccactaaaaacaacattcatttccactgtggaaaaatgaaagaatgtgggagtccccaggctggtctaagcatttccaaaccccagagtcagaaacagatttgtctagttgatggcttgtcacgtgatccgggtaatcatcacattgaatatagtgatgattgaccttattattttaccctattttttt

SEQ ID NO: 123394 - DNA, 1633 bp, Homo sapiens
  Payload ID: 4229
  Gene Symbol: CNGB1
  Gene Name: cyclic nucleotide gated channel beta 1
  Uniprot ID: Q14028
  ENST ID: ENST00000311183
  CDS Start-End: 66-965
ccagctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccagggtgatgggagctggaggtctctgaaataagggagaagggaatctgggagagctcagatggacacatggatggaaggaaagaaggatgccctgaagagaagaccttcccgggggaggtggccactgacaccccaccctatttgaacagcgaacccctccctctccacacactcccaggcaggacaaggggagccagagtcacctgcaccagccccagagcctcccagaccagaacaaggggaaggccagccatgggcagcctgcaagatttaggctagacagcaggacttacccccagagggctgtggaaaaggcccatagccgggcgtggtggctcacgcctgtaatcccagcactttgggaggctgaggcaggaggattgcttgagccccgaagttcgagaccaccgtgggcaacacagtgagaccctgtctctaaaaaaccttttttaaattaataaattaaaaagccccatggatggaggactcagtattgagcatctctttgagaggacgcgtgcacagcccccagtgtggtacctggcaccgtcagcacctcgacaggatacagtttttcccagaagaggttctccctaggcctggccacactctctccttccaaggcttggggacaccaatgagcagcaacaaatgttttcattaacattaaaagagtgtaaatgagcacatcaaa

SEQ ID NO: 123395 - DNA, 4364 bp, Homo sapiens
  Payload ID: 4229
  Gene Symbol: CNGB1
  Gene Name: cyclic nucleotide gated channel beta 1
  Uniprot ID: Q14028
  ENST ID: ENST00000564448
  CDS Start-End: 62-3799
ctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgccggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctgcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaac

SEQ ID NO: 123396 - DNA, 709 bp, Homo sapiens
  Payload ID: 4229
  Gene Symbol: CNGB1
  Gene Name: cyclic nucleotide gated channel beta 1
  ENST ID: ENST00000562761
  CDS Start-End: 67-709
aagtggcgggagctactgtgagtgctccagggagggctaaggactctgtctcctacaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccc

SEQ ID NO: 123397 - DNA, 378 bp, Homo sapiens
  Payload ID: 4229
  Gene Symbol: CNGB1
  Gene Name: cyclic nucleotide gated channel beta 1
  ENST ID: ENST00000565942
  CDS Start-End: 1-378
caacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggccaagagctcgcaagacgtcaagggagaggaaggctccgccgccccagaccagcacacgcacccaaaggaggccgccaccgacccaccc

SEQ ID NO: 123398 - DNA, 4347 bp, Homo sapiens
  Payload ID: 4230
  Gene Symbol: CNGB3
  Gene Name: cyclic nucleotide gated channel beta 3
  Uniprot ID: Q9NQW8
  ENST ID: ENST00000320005
  CDS Start-End: 49-2478
aaggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttaggaagttgtcctcatgaattagctagcattagcataattaccgacgttgcatgctgtgaggaggctacaaaggccaggctggtgtcggaagtaataatacatatagaattccattctaataaatgccattagtgtataacatcaagttctgtgtaatgaggctatttccaagtctccaaagatggtcactgtaacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgcctggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttaccta

SEQ ID NO: 123399 - DNA, 500 bp, Homo sapiens
  Payload ID: 4230
  Gene Symbol: CNGB3
  Gene Name: cyclic nucleotide gated channel beta 3
  ENST ID: ENST00000517327
  CDS Start-End: 1-336
gcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagggtcagttcttacctgtgtccttcactgctgggatattcttaggtcacctgagactctgaactggaataattgactctcttgctcctttcctctgccgtaggagcagcacatcccagataaggctgttccttcagcctgagtcccaatataagaaacatggagagaactccagcctagctgcatgtaaaatgagcaagaaataaactgttgtcattaaagccac

SEQ ID NO: 123400 - DNA, 1879 bp, Homo sapiens
  Payload ID: 4231
  Gene Symbol: CCNA1
  Gene Name: cyclin A1
  Uniprot ID: P78396
  ENST ID: ENST00000255465
  CDS Start-End: 265-1662
ccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttaga

SEQ ID NO: 123401 - DNA, 1758 bp, Homo sapiens
  Payload ID: 4231
  Gene Symbol: CCNA1
  Gene Name: cyclin A1
  Uniprot ID: P78396
  ENST ID: ENST00000440264
  CDS Start-End: 289-1554
gagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatg

SEQ ID NO: 123402 - DNA, 1699 bp, Homo sapiens
  Payload ID: 4231
  Gene Symbol: CCNA1
  Gene Name: cyclin A1
  Uniprot ID: P78396
  ENST ID: ENST00000625767
  CDS Start-End: 100-1494
gacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatga

SEQ ID NO: 123403 - DNA, 1751 bp, Homo sapiens
  Payload ID: 4231
  Gene Symbol: CCNA1
  Gene Name: cyclin A1
  Uniprot ID: P78396
  ENST ID: ENST00000630422
  CDS Start-End: 282-1547
acaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatg

SEQ ID NO: 123404 - DNA, 2797 bp, Homo sapiens
  Payload ID: 4232
  Gene Symbol: CCNA2
  Gene Name: cyclin A2
  Uniprot ID: P20248
  ENST ID: ENST00000274026
  CDS Start-End: 305-1603
catttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctta

SEQ ID NO: 123405 - DNA, 2797 bp, Homo sapiens
  Payload ID: 4232
  Gene Symbol: CCNA2
  Gene Name: cyclin A2
  Uniprot ID: P20248
  ENST ID: ENST00000618014
  CDS Start-End: 306-1604
ccatttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattatattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttacctt

SEQ ID NO: 123406 - DNA, 5959 bp, Homo sapiens
  Payload ID: 4233
  Gene Symbol: CNNM1
  Gene Name: cyclin and CBS domain divalent metal cation transport mediator 1
  Uniprot ID: Q9NRU3
  ENST ID: ENST00000356713
  CDS Start-End: 290-3145
acttttggagtaggaggccatgctgcaaacccagacttttcaggctgcatctcagatataccgaagtgtgtacccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgggggagaatggcaccggcgactgggctccgcggctcgtgttcatcgaggagcccccgggcggtggcggcgtggcccccagcgcggtccccactcgccccccgggaccgcagcgctgcagggagcagagcgactgggcatcggacgtggaagtcctggggcccttgcgtcccgggggcgtggcaggctcggccctggtccaggtgcgagtgcgggagctgcgcaagggcgaagcggagcggggcggcgcgggcggtggcgggaagctcttttcactctgcgcctgggatgggcgcgcgtggcaccaccacggcgccgccggcggcttcctgctgcgcgttcgcccgcggttgtacggcccaggcggggacctgctgccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagttgtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaaccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctccccccgcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagaagccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctggaa

SEQ ID NO: 123407 - DNA, 2059 bp, Homo sapiens
  Payload ID: 4234
  Gene Symbol: CNNM2
  Gene Name: cyclin and CBS domain divalent metal cation transport mediator 2
  Uniprot ID: Q9H8M5
  ENST ID: ENST00000369875
  CDS Start-End: 165-1823
gcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaagaacacacaaacaagaaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggccaccatggtgaaaccccgtttctaataaaaatacagaaaaatta

SEQ ID NO: 123408 - DNA, 15857 bp, Homo sapiens
  Payload ID: 4234
  Gene Symbol: CNNM2
  Gene Name: cyclin and CBS domain divalent metal cation transport mediator 2
  Uniprot ID: Q9H8M5
  ENST ID: ENST00000369878
  CDS Start-End: 189-2816
tccctccctctttccctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccagttcctttgtccctgtctcgtacctttgttgtcagcagaacagagttgttagcagcaggttctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaactatagcttatctgtgttttgttagcccgagggatatgtgcaggttgttggcgctattcatgcactgaaatgaaatcatactgaccagtgtacacacaagattatcagtgcccgccgcatccatcactaggaaaggagagagcgttttctgtttaggctcactgcgcaaagggaggccttggctaagtggcagttttcttctccctactccaggtaggaagtctgttcagccacggctgggctgtgtgcggggcagggagcgtggctgaggagcagacagcagcgggccgggctggctgcctggtgagcagtttggtgcctcgggtgttgtgcatgcccggctcagtatttcctctgggatgccagtcctggagtgtcttcctcagaaggtgccgtgtcccttagtggggggaagtactgatctcacttggtgtagagggtcacagggaccccccgagggtgctgagtggcctgctactggcacgcaacctgcccccgtgggatgaagccccaccgcgtagcttgaccttagaggggaccccactctaagcatccttttttttaaacagagccatctagatacaaaagtcagtttcttaagatgcctctcactgagcacaacaccagtgtgatgagtgtataaagatgaggggtccttgcaacaaagcaaagcgtagcccatgctggaagagggcatctatccccctcttcgggtctgcgcagtgctggccttccctgagctgtggggagccaagcctgcctagcccagcttctctggcctcaggaactctgccctgtcaacctatctgggctcacgtctgcttctccacacacagtctctcggggatgccttgctactgggagagcctctggaatcagagctagtgtgttggtgcccttttcagagctctgctgttcctttataaatcctaaagaactgagtctggggagaggagaggggatgccagctgctgcctctgacttcagggagaagcagacttcttaatactgtcttacgtgctcggtgtgatggcttcttgcaaattattctcttataaaagagctcggcaggagtggcatcagtgaggctcccaaaggatgaaattttagccgccaagttcgtattcattttctgttattctttaccttctgttagtcacactattttataacattagggaatctaaaataattcctgtcaggtccctgaaggaatgaaggctaacatctcctttggggagagcttaggacccttcaaacaacactcatgtctgagcggccagattcctcctccaggccccattttccctcaggaaaccaacctctcagatggttggaggagaaacactgggctgttgcttctttggggcagcaggagaatgactttggcttggaaggcctctgccattcatctctacaaagccagtggggtccggcagagaaagaccgtggaatagctgcggtctcgatgtggctgctctttggcacctccgctggactgccctcccgcggcggtgaccttttcaagtgtggaagggagtgggtcgagtggaccagatgcagacccctgagttctggatactgatgggaggcctcaccctcctttacggggcctctctgggtgggacagagcctcacctgctcctgagcagccactggtgccccacggttcctctgaaactaaatccctagcatccagatagtcctgggacactctgcctgctctgtaaatgaggagggcttttctcctgctgtttggaggttccgtcccttcactgcttgtcccatatgcgtcaggcaaattcaaaatcatacatttaaactcttaggaaaacaaaatcttaagacttacacagatatcggggtgctaatcaactggcttaaatcttgattcttacataatttgaacttgaaaggttacattgaactctgttctttcctccctcctcacctcactccctgcagggagttcaatgccatgttgaagtggttggcatccccaagtgggagggagtggggcatcttaccatcttctaatgtgacttcaaggaacagtgcaaatgttgaatgcagagcttcacactaatacggaacagtaactgtgagtatatttacctgtgctgtcgtcagcactgtacactaaaggaccagcttttccaagcctaggaaaataatggtagatacaaatagaaatacattttccctaggaaatagagcaataggaatttgagctaagcaggtaccatgaacttctgccctcaaattctctctttgggttgaggagcagacctgtataggccctggctgatcaagtctgtgtcctgcctagtaaaaacacacaaccacctctgtcatctgaaggccagccggggatctgtagccatcctcgccttgcctaggcccaggaaggtgaggtctcctgggcaaccagagttgcccctgtggttccccaggggtgatcctaggcagatgactcacccgggctggcacaggaaggtgctcaccttgttctctggggctccaagcaagagcaggccagggagggctggctttgcacgctatgtagcatgacccaagctccctggtggcatgggaaaaactcccctctgcttttgagcccagatatgggcttttctttgcaaagggttgaggagaaatacaagactgagctggtaggttagggtccagaaggcctctgaggtgccattgcttacttccttactgaggaaactggctcttgtcctgggccatgtagttccattctgggctctaggctagtggtgcttctgtccatcaagggtatctgggtgagttgtaggttaacccagaatttagtagggatataggggtttgaataggaaagtgatctggggattcagaaatttttctgatgtatcaatgagcaacttctcagtggatttttatacctcagggtcatttgcaaatctttatcttttcctatttcttaggtgttcaagttggttaataggagagagacgttcagagacttctaagttgaggttcatttgcctccgtttgaggggtgagtggtgcaccaatagcttgctgctgttacttagcaaggctgtgacaagtaggccttcctcctctagcacttgcaagctttctgtctgcgatcacggtttacttgcccatttcccttttgctaccttctttcctatctggagattcatattctagagtccctggtcaaccctacggatgcgaagaagagatggcagttcacagcaactgcatagagtagggagcagctttcctcccaccatcctaggctggggaccttctttgcttctcacaccactgtggttggctcagctcaagtaagcacgttctctctgtatgctagagctactgacatcatctctactagaattgttttaaatatcttttgatgggaaataccaggttgaacttcaagcatcatggaaacaaaggttctagctgcaagagagtaaagttctaggtgtttgtatgccaaggtttatatgtacacagatccaacacatactgtaagaaagacttgagtacacaaggttttcaggttttaatgcccattgggaccgtgaacaaatgagaagaatgggagcattgtcttgcctcgcttggaaggacgccttccggcatctgatccacatggattcacttttaggatgcagttctttgggggccagatttggctgcagattcaccctgaagagaactatccaatgggcctggtggggcttgggtgcctgccttttttgttggaggctcagacttctagagcagagcaaagttgggaagaatgaggtcttaggattctcattccccagagagccccagcctcgcttctgatcattactccccaagtctgaatctactgtgaaggtgaagttatcaattttttcttgtttgagtcctttaaacccacaaatgtatatgctttattttatattatttattatgtacatatgcctgttagtacttcgtctgtgactaggacaaggtctgtcttgaagcttcctcatccatggatcctagggttctgctgtcctttaaggcgggtgagagggtagtgttgttttttataaacaggttgctgcttttatgttggccctagcatccccagcccctttagttgggcccacctgtattccttatgaccagtgttttggatgaggatggaggcaggtctcctaccttgtgggcagggcctctcaagtacctccatgaaatatttccaaggtggtttcttggtgacaggctctcttcccctatgtagggtacagtacagctgtgagtccacggcctccctcctcccaaggcaggtcacttgcctggccccacagtgataatggtttcttccacttaccttagattgcataatccatctttctggataatggaagctgcctgcctatctgggctcttaatatgccttttcttggttttgaggcccagtgccaacattgccttggccctcaagtaagaccctgctttgtgtctgactttgatcctcctcagcctttattcactgtatcatagtgtacaggtcatgcatttgagcagtgaagttttctgaacacagtattcagagctgtgtacataaacctaaataagcacaaatgacatgtataggattgagctgattgtcttaatgaatgcattttataattcaaatgatgtagatgtacagtctctcctatttattttgtaccaatttatttgtaaattttgtgattgttttacaaggtttttgtttatttctattctatttagataaatgatgttctgttcaccctgctagcagatgtgtgttccctcttccctttcatctgtgcaacaccaaccatgccattgtattcagcttggctgaaccaactgccctacccacttgcctggctttgctggtgggaaagctgggactggatctcagcatgacaacatagaagagcatcttctttggacagtgtaaagtcttaagagaagtgggtactagttctgtgcctccaagtcacagcctggtacagccaatcctagggggaaggtgtccttctttgcaaggattataatctgttctccatcagttactctctacataagaacattcggagtatccagtcaaattgccccagacattggctgctcagtcactaataacaacacacagtgccgctgggctaagccggcatttcctaggtaagaccaaaggtctcattcaggcctctcaattggctcttgaaaacaaggatggctttataggtcctcctctgctatgctaagcctgggaggaaggtcggagcaggcatggatagtcactttcaagtggaaaacatccggcctgagtgtggcgaggcgtgtgcaggtgggtcttcaggattcagtggatatcctgcattccccagtaatcggtgtgtatgatacacgttcttttccatcactactttgtcttctgttccttcttaccctcatcactcacatgagaccagtccctgaagaacttacggtggagcttcagggaccctctgtgatccattcctaaaccacatctttttggaatcccttttctctccacttttagtctctattttacattccaaagaggatcgtgctctgaaaatttagcctcttgactggtccatttatagtctccactgaatttatttaaccgtggcatttgcagtcttttacttacacttgttctgtggatggagacatttcagggaagaactgctgacagaattggctttcagacactgcctgacctaactaccgctcccatctccccaggtatcgcccaactacctgaaagtagaatgaggtgtatcttagcccagtgaaatgctgtcttcgaaccctgcttgctttcattagaagcagggcagaaagtggcagcagagctagggaaagaaatcatggtagcacattcactcccagcctcctgccttggtttgtttttcctgttttactcacttggtctagatgagcccttagctcaaatcaggaaatgctccaaggaaaatggaggcaatttttcctgctgtcaagatgagatttgcctaaaactcccccctgcatcctcagagtgcgcacacatccgctcatttctaagctttatcgtgatgcacccggggtttctatttcacaaaaattgtgctccctagagccgtttttcaactcggcacttctgaggaaacaaatattgatcagagggtcttgtagagaaagtggttaaaaactgacctttttatagcctggagttgatttctggaaacttattttatactttttgaaggtaatttaaaagagatgattctttattaaagccaaaaagttgaattctattaggtggataataaactcttttgctttctttgtatggtggttttgtcattttccctccaagggcctcatatctgtgctcttattttcaagcagtcccaggacaaagggatggttctagggcccttttctctgactttctgctggcatgccatctcccctagtggattactgaggactgaggatgcacgtttctaagggagaattagttgcccgacttctgaagtgcttttcctgtcagggtattagtgactgtgcagtgttcaaacaggaggccaacacatgataggaaattttagatggggccagttttcctactgcagttctactaagtcattgacttgaggtcagtgggtccaaaaagtgacttgtttaaagatacccacacactcaagtcaaagataactctggtgagaacactctctcaaagactggacactgagtaaacatttttcagtgtggggaaggtttgcttggcaaatcttctttccaagtatctcaagaacttgtgagacgtggaaggactattgctgcctttcgtgggaaaaatgtgtgctcagctgcttgggctccagtttgtgtgggaaggtttatctcaggccttgtctactcccctcgccagacatggctttgggaagagctccatgggagaccagaacatctggggacatagttgtacctagttattttgtgtgaagaaacaaagggacgagattcaaaattcatcattgtgttttaaatttaaattggaaaacatagattcctcatccttaaacagagtcagcaagtttgagatgaaatgtttgtgttcaatggggagtacttttttgtgttaaagctctacagagaaacttctgtatatattttatttttgagatcacatacctttgttggaatgaatcagactgttgtggccttgggatgaagacattgtgtgtgaggacagggaaaaatggttgagaaatccaggttaaagaatagaaaagctttttactcattctataaatgaacatgctgcctgtttaaaggacttgctttctgctgtttctagatacctagcagcgcgagaactgtgtgacgtgctgcgttcttgttacgggaggtgcgtgacggggcagcgggggtttctggaagtcacctgtttctgctttctggttgcctgtgcctgtggtcatccctgctccttagcagtagtgcatgtttttcttctatctgcagggttgctctggtagctccatggtagagatttcactctcagggcctcccaaaagttgtgtatcatttgaaattgttctatttgaggaaaaacttttaagaaaagctggattccctgatcaccactaaagatcatcatgagaaacataagtatttgagccctaaactactaagcccagtgaggaattggagcgttaactgtatggcaatagctagatcatagttaccatttttcccaccatcaaagacagattaaatagtttccataacatggaatgtgggtaaggttcctaccctaatacagacttaaatatgtagttgtctcaggctattcgtggtgaataagcagagtatttattttaaaatgaccaggcagccttggaaaaattgctgggctttaaagttgttgacaaagtatttcttaaataaatacatctgatttagaaatacctaaacatggacaaaatacttctaaatctgacatgcaactgcatgtggctttttaaagtggtttcttaacaatgctaatgtgacttaaggatttgtagttctattaaaaacgacttctaaaagtatcttagggtagcttgaagggtttgcgttattattttaggtctcagcagaggtatgcttatggcaagagaaaaatcttaggtctaaatagaaccctaaactttcttggctgtgaccaacttttctgaagtacaccatcagagttttcactgactatctatctttgcagagatgaatgaatgtactgggcaattcctctgcccaaggaaacccagcagggcctgggtctgctgtaccactgaccaactgctggggaggctaggggacctgtcagtacatgctgtaaggttgggagttcagtctagcaaccaagaaggggttgcctggtgttctacaatgcctatagtgttttcaaaatgcctgggaaaaaattctcaaaagaagtggcagaatggtcttctcacggtataaaactccgcaggattttttttttttttttttttttttttttttttaaggaaaaaagtataccttttaagttcagcttccttaactactggcaacagagagaaaactcataatttgttttaaaaagcccagttacagctgccctgcctacccatggaccattgacttcccagcacactcttaagaataatatacagagaggcaccattttgctctgggtcttatggaatcctagagctcttgaatacgttttggtggtcctacggagagctgtaactagcagtggagttgttgcttattccagctgtgtgcttttcactttccgatctttggacccagagaatcatttgccatggaatcatctggctagtaagacactcttatatggatgcaatacaaaaagtggtaaattaaagcaaagcaatcatgtggtccttactctaaaagagacaatatgtaaatgtactattataataaggtagctctgcagatgtaataagctactcataaattatttgggtttaagaaaacttaagactatgttaaactggacaacatctccatcttgagtgagagtaattagtaactaggatgaccacacattctcctaacacgggcaacagtctagtctaattgttattgcatttctgacctgattcttttaaaggggcatatattcccaatatataccatttagaatgtatgtatgtttcttggatgacttaatctgaagccatataagtccaaagtagtgagacagacagtatatccttgactaagttatcaggctgtgttctctgcttataaaataattttttaaaaagcctcacttcacagtcctgttccaaaaatctttctgtgaaaaaattgaggcctatgtaacaccatgaatataatcatgttagaacataatcagttcttgaatatttatttcctttaagagaatatcaaactgatgtcaccaaatctaaacccacttgaagaccaatagctattacagttgtactacagaataggtcaaagtcaccgttagaaatattacactttattgaattctggagcagctaatctaccctcccctattgaccaatgacaagaatggaagaaaatatacaatggttaaagaaagagtctataaccactgtttgtttaaaatgttgaaacaactttcactgtactggtgaaacagttttaataccctaacatacacagtaatgattcattcttgtttaaaacaagaggtgatttcgacttgggattgggatttttattttttgagatggagttttgttcttgttgcccaggctggagtgcaatggcacaatcctggctcactgcaacctccgcctcctgggttcaagcaattctcctgcctcagcctcctgagtagatgatgggattacaggcatgcaccaccacgcccaggtaattttgtatttttagtagagatggggtttctccatgttggtaaggctggtctcgaactcccgacctcaggtgatccgcctgtctcggcctcccaaagtgctgggattacaggcgtgagccgccgtgcctggccttgacttgagattctgaagtgaatttattcacactgattgtgccctctactttagtaaggttctggcttacagagccctcttcccatcctctgatgttcaattttaatatacagcaatcaactcttagaggacaaagaaatctggaattgggtagcatgagccacagctatatagcccacactaatgcatgttctgtagtataagaaggcagttcttccctttcttttctgggggcttgttcctttgtccacttgcagctaaattctttctatagatttatcacagataagaaggaggttgtttttggataacaaataagcatttgtgctattaaacaaacaaaaggtaataaggatactgtcttttccctcaaaatagaatcctgccctaaagcaacgcaagtagagcatacttctgtgcaaagccagtgatagagaagcagccttgccagagtcactgaggatgaattaaaggcttataaaagaaaacttgaccttaacagagactacatttgatcatggaaataatacatttctccactgatatacaataccatgtaatgcactggaaaagttggaccttggagtaatagcacaatttgtaacattacagatcacctcttcccactctttgttccactctgagactctttccttttcctcgtgtatccagatacactgacatacggatgattttaaaagtgtcacaagccacagtggagccatatacatgcagttcagcctgattttacccttattttcttctaatacagactccattacaattttggaccatctgcagagagtacagatacacaaaaccaaaacaagtatctatgataataaaatcttcagaaacttttcagacgtacctttcatggagccccctccctcccccgagtagaaccctaacagggacctcgtttgttcctgtgagtcctgccaggacttgtttaatgggtgcttggggttttggttttcctccttattcttcctcctcctcctcctcttcatcatcatcttcgtcatggcagtgtgtaatttcctggggggccagtgggaagaggttgggaggtttaatctcactaattgaccgtgtcagctggtgccgcttgtagtcagtgtctttgaaatccactgatgtgcggttccgggtggcaagaggagactccatctcattgatatctacgtgtgtgtgctccaccgttgattcatgaggcatctagacagaaaaaagctagaggctcagaaagcaggcagagcaaagtagctactccccaaatcctaacccctctcctctgttaggtggccatgcaattacatctataatggaccacaggacaagtcaatatagacttatcttcatagaactacttatagttgcctgtcttcctctctccctgcccctcaaaatggtgcccatattgtctactgcagctggaaattggaaaagatggagaggggagtttactttctattttacagcaaaaacaagatagtcctgaaacagatcagaataaaggaatgtaaaaacc

SEQ ID NO: 123409 - DNA, 3857 bp, Homo sapiens
  Payload ID: 4234
  Gene Symbol: CNNM2
  Gene Name: cyclin and CBS domain divalent metal cation transport mediator 2
  Uniprot ID: Q9H8M5
  ENST ID: ENST00000433628
  CDS Start-End: 125-2686
agtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggc

SEQ ID NO: 123410 - DNA, 3447 bp, Homo sapiens
  Payload ID: 4235
  Gene Symbol: CNNM3
  Gene Name: cyclin and CBS domain divalent metal cation transport mediator 3
  Uniprot ID: Q8NE01
  ENST ID: ENST00000305510
  CDS Start-End: 29-2152
gcgagaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgagggaagtcccacctggccatcgtgcagaaggtgaacaacgagggtgaaggcgaccccttctacgaggtcctgggcctggtcaccctggaggacgtgatcgaggagatcatcaggtccgagatcctggacgagtctgaagactaccgagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaa

SEQ ID NO: 123411 - DNA, 3308 bp, Homo sapiens
  Payload ID: 4235
  Gene Symbol: CNNM3
  Gene Name: cyclin and CBS domain divalent metal cation transport mediator 3
  Uniprot ID: Q8NE01
  ENST ID: ENST00000377060
  CDS Start-End: 34-2013
gctgcgcgagaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaa

SEQ ID NO: 123412 - DNA, 4800 bp, Homo sapiens
  Payload ID: 4236
  Gene Symbol: CNNM4
  Gene Name: cyclin and CBS domain divalent metal cation transport mediator 4
  Uniprot ID: Q6P4Q7
  ENST ID: ENST00000377075
  CDS Start-End: 99-2426
agttggctcggcggcagcggagcggccggagctgcggtgcggaccggggccgcgcggcgtggcgcggggagcggcggcggcggcagagccagagcaacatggcgccggtgggcgggggcgggcgcccggtcggcggaccggcccgcgggcgcctcctcctggcggcgccggtgctgctggtgctgctgtgggcgctgggggcccggggccagggcagcccccagcagggcacgatcgtgggcatgaggctggcgagctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaa

SEQ ID NO: 123413 - DNA, 2169 bp, Homo sapiens
  Payload ID: 4237
  Gene Symbol: CCNB1
  Gene Name: cyclin B1
  Uniprot ID: P14635
  ENST ID: ENST00000256442
  CDS Start-End: 254-1555
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaa

SEQ ID NO: 123414 - DNA, 1331 bp, Homo sapiens
  Payload ID: 4237
  Gene Symbol: CCNB1
  Gene Name: cyclin B1
  ENST ID: ENST00000506572
  CDS Start-End: 129-1331
aggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaa

SEQ ID NO: 123415 - DNA, 1190 bp, Homo sapiens
  Payload ID: 4237
  Gene Symbol: CCNB1
  Gene Name: cyclin B1
  Uniprot ID: P14635
  ENST ID: ENST00000505500
  CDS Start-End: 1-1190
atggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgta

SEQ ID NO: 123416 - DNA, 750 bp, Homo sapiens
  Payload ID: 4237
  Gene Symbol: CCNB1
  Gene Name: cyclin B1
  ENST ID: ENST00000503507
  CDS Start-End: 1-186
gcgctccgagtcaccagggtgagccgcttcggactgcgaactaacgcggccttcttagctgctgcctgctctccctgcctcgcctgcgggagcctcccgagcgggagagggccgcaggagcgatttggggaggaaggtgggaggggactcaccaagagagcgccgaggtgggcccaggcctggtgagagagtgtgggggacgatggatggagggaggaagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaaga

SEQ ID NO: 123417 - DNA, 780 bp, Homo sapiens
  Payload ID: 4237
  Gene Symbol: CCNB1
  Gene Name: cyclin B1
  ENST ID: ENST00000508407
  CDS Start-End: 48-780
gtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgg

SEQ ID NO: 123418 - DNA, 767 bp, Homo sapiens
  Payload ID: 4237
  Gene Symbol: CCNB1
  Gene Name: cyclin B1
  ENST ID: ENST00000507798
  CDS Start-End: 1-558
caagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatatta

SEQ ID NO: 123419 - DNA, 1305 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000353689
  CDS Start-End: 290-1123
acttcccaaggcgacttcctgtctctccactttctttccctctccgttttggtgggctgaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaca

SEQ ID NO: 123420 - DNA, 1479 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000358932
  CDS Start-End: 466-1299
ctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaacttta

SEQ ID NO: 123421 - DNA, 1613 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000398160
  CDS Start-End: 598-1431
aatagactgtgcttcatgtgcacagtgcgtgtgttcttggaaaacgccggcttcattttgcttggcgggaaagatattatcatcctaatgctgttttgatttatatctccctgggtgaggtcagatttcgggagaaggcgttcagctcagtagagtttaattctccggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaca

SEQ ID NO: 123422 - DNA, 1604 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000398163
  CDS Start-End: 650-1483
tcaggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgacggagggtcgctcttgttgccgtggctggagtgcaatggtgcgatctcggctcactgcaacctttgcctcgtgggttcaagtgattctcctgcctcagcctcccgagtagctgggattgcaggcgtccaccaccacgcccagctaatttttgtattttagtagagagagggtttcaccgtgttggccacgctggtcgggaactcctgacctcaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcc

SEQ ID NO: 123423 - DNA, 1631 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000398169
  CDS Start-End: 618-1451
gtttcaggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgccggagctgcggcccgcaactccctcagcctggcaggtcccaggatgcttcggggcaaccccacgcatgcgcgctctggcgtagttccctgaagcactcgctcgcagagaatcctggaatcttcgcttgtggagctgtggaggcaacggagtttttccgcgctttttctttcagcctcaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaacttta

SEQ ID NO: 123424 - DNA, 1686 bp, Homo sapiens
  Payload ID: 4238
  Gene Symbol: CCNB1IP1
  Gene Name: cyclin B1 interacting protein 1, E3 ubiquitin protein ligase
  Uniprot ID: Q9NPC3
  ENST ID: ENST00000437553
  CDS Start-End: 671-1504
acttcccaaggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatgccggagctgcggcccgcaactccctcagcctggcaggtcccaggatgcttcggggcaaccccacgcatgcgcgctctggcgtagttccctgaagcactcgctcgcagagaatcctggaatcttcgcttgtggagctgtggaggcaacggagtttttccgcgctttttctttcagcctcagagcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactttaca

SEQ ID NO: 123425 - DNA, 755 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000554047
  CDS Start-End: 1-194
gtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctggggtctttcacagagcagagatttttaagtttaatgaagtcctgcttatcaattttctctttcacggattatacctttggtgtattttaaaagtcactgccaaatccaagatccacctggattttaccctatgttatcttctgggagtttcatagttttgcattttatgtttaagtctgtgaaccattttgagtttatttttgtgaaaagtataagatctgtctagattcattgggtcctcaattttttgctggctattggccagaggctgttcttagttacttgtctcttgggccttcctgacatgactgcttgcttcctcaaagccagcaagggagtgtgtctcctagtaagacagaccttatagtcttaggtaatatacttatgaagtgacaacctgtcacattttctgtagtattctagtcacaggtcctgcccac

SEQ ID NO: 123426 - DNA, 513 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000554184
  CDS Start-End: 1-94
gacattagctcccgagcgctggccttctggacatatcaggctagtctctaactcctgggttcaagccattctcccgcctcagcctcctgagtagcctgtgcttcacttggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttca

SEQ ID NO: 123427 - DNA, 392 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000553291
  CDS Start-End: 381-392
gttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctgaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgt

SEQ ID NO: 123428 - DNA, 646 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000556563
  CDS Start-End: 444-646
ggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggaatgttacagactagactaccactccatcaaatactgaagttgttggaatgtttgctttcttgaatgtcgtggtcactctggcctggccttcacaactcttattgcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatgg

SEQ ID NO: 123429 - DNA, 1294 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000556854
  CDS Start-End: 481-789
ggcgacttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatatacacttatacttcttaaggatgtttgtcatctgtcaagtaactttttattatatttttctgggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcgggg

SEQ ID NO: 123430 - DNA, 1331 bp, Homo sapiens
  Payload ID: 4238
  Gene Symbol: CCNB1IP1
  Gene Name: cyclin B1 interacting protein 1, E3 ubiquitin protein ligase
  ENST ID: ENST00000557665
  CDS Start-End: 870-1331
tttctttccctctccgttttggtgggctggtgagtgtgcgcttaattttgctctctaattgttttgaatttctcttccatttgagttatatacccaggtggcaggcctttatttcaagtcggcataggagtgtgtgtgagtcgcaaggagattaatttcggctgtgtggaggttgggagaaggcagtgaaatgctcttcctggcttgtttccacgtgggcctctgcagtactgggtttgccttccgtctccgagtcctggtgacccaggaacaatagactgtgcttcatgtgcacagtgcgtgtgttcttggaaaacgccggcttcattttgcttggcgggaaagatattatcatcctaatgctgttttgatttatatctccctgggtgaggtcagatttcgggagaaggcgttcagctcagtagagtttaattctccggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaag

SEQ ID NO: 123431 - DNA, 1556 bp, Homo sapiens
  Payload ID: 4239
  Gene Symbol: CCNB2
  Gene Name: cyclin B2
  Uniprot ID: O95067
  ENST ID: ENST00000288207
  CDS Start-End: 192-1388
gtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 123432 - DNA, 1064 bp, Homo sapiens
  Payload ID: 4239
  Gene Symbol: CCNB2
  Gene Name: cyclin B2
  ENST ID: ENST00000559622
  CDS Start-End: 113-925
gcgctgcgggctcggagagcagtcctaacggcgcctcgtacgctagtgtcctcccttttcagtccgcgtccctccctgggccgggctggcactcttgccttccccgtccctcatggcgctgctccgacgcccgacgggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggagaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaa

SEQ ID NO: 123433 - DNA, 2503 bp, Homo sapiens
  Payload ID: 4239
  Gene Symbol: CCNB2
  Gene Name: cyclin B2
  ENST ID: ENST00000621385
  CDS Start-End: 1-1125
atggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgtaagtactactgttttcttaagctgtggaaagctttaggttctgggttttgtgtgtatgttgggcgggggggggcggtgtgtgccgtcatgtaaatatattaataacatgtgggagttttagcacaaatcctttatcctttatatttttctggtacagtatggtatggagcatactgataaaccctgaaagcaagctttatttgaaacaaggtcgataggctagccatgtccaggcccagatcccagtcaaccagtcggttactcaatgtattgaattactctgtgcttatactagcatcctggggagggcactttgcaagcagggaaggctggtctgcatgtgattgggaagagagagggcccacttcaaatggcggtgtattatattgcgtattcaggtgatgttactcagagcctttgtccagggtcttttgaggcaatgatggaaaaacgcctaattagcaagcatggttaagagggaagaggcccattcagggggcatcctgagggcatggtgtctatctctgcatggcccacctatgaggaggagccaaaggagacttagtgctgtcctgtgcttgtgtgacaccaaacatcagagctcaccaagtgtgtggtggcaaagagcaaggtatttgaacctcagaagagtctcaagtgtcctcacaacatgatttgcttcatggaagtgtaatatgtgttcagtcctgagaggactgtctgggatttgttaagcactagttgccaccctcttttattgtcttttattgtcttttaattgttcctattgctgccaggcctggtgaacctgttatgtcctgatggcacttaggtgtcgtaaacacagctccccctcccatccctctggtagcctacaagaggaagcctgctacttggaccttgaaatcatttgttcctatcacctgtgctaccagctgtgttttattcattaatggggatggaaggaaatggtcaggcacatgttatgagcccagagctttcactggcttcagcgattgggcatcatcaatgtgatcatgattgtagccgtggacctttgataattgtgagttagactaggaataaggtatcattgggggttcctgacatgtgcttaatcacaaatgacttctgcaggccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggt

SEQ ID NO: 123434 - DNA, 4513 bp, Homo sapiens
  Payload ID: 4240
  Gene Symbol: CCNB3
  Gene Name: cyclin B3
  Uniprot ID: Q8WWL7
  ENST ID: ENST00000276014
  CDS Start-End: 119-4306
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 123435 - DNA, 1201 bp, Homo sapiens
  Payload ID: 4240
  Gene Symbol: CCNB3
  Gene Name: cyclin B3
  Uniprot ID: Q8WWL7
  ENST ID: ENST00000348603
  CDS Start-End: 119-994
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 123436 - DNA, 1201 bp, Homo sapiens
  Payload ID: 4240
  Gene Symbol: CCNB3
  Gene Name: cyclin B3
  Uniprot ID: Q8WWL7
  ENST ID: ENST00000376038
  CDS Start-End: 119-994
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 123437 - DNA, 4693 bp, Homo sapiens
  Payload ID: 4240
  Gene Symbol: CCNB3
  Gene Name: cyclin B3
  Uniprot ID: Q8WWL7
  ENST ID: ENST00000376042
  CDS Start-End: 299-4486
gtggaagcatttccgtcattctgagacagttgggctgaggcggttggtcgcctctctctctctctctctctgttcctcatctacattttgattggtttatttttgtattgttttctttcagtttccgataggtggagaacattctgctaatagcttttcttccagtccatttgtggcttgttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 123438 - DNA, 1521 bp, Homo sapiens
  Payload ID: 4240
  Gene Symbol: CCNB3
  Gene Name: cyclin B3
  Uniprot ID: Q8WWL7
  ENST ID: ENST00000476167
  CDS Start-End: 119-454
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatgataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 123439 - DNA, 2212 bp, Homo sapiens
  Payload ID: 4241
  Gene Symbol: CCNC
  Gene Name: cyclin C
  ENST ID: ENST00000326298
  CDS Start-End: 105-713
gctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagtaatagactaatccttgcatgtgagctttcaataatatgaactgcaactgtcataaatcaggattattattcccccaccccctttttgcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 123440 - DNA, 2118 bp, Homo sapiens
  Payload ID: 4241
  Gene Symbol: CCNC
  Gene Name: cyclin C
  ENST ID: ENST00000369220
  CDS Start-End: 102-950
gatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 123441 - DNA, 1704 bp, Homo sapiens
  Payload ID: 4241
  Gene Symbol: CCNC
  Gene Name: cyclin C
  ENST ID: ENST00000482541
  CDS Start-End: 102-533
gatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtatgtaagtgcaaaaagtatatctgctttaaggatgtaattctaaagaaagctccagagtacatagatttttttttttttagtttatgagacatatgagattggttggctttattaaatttcctgaggataactttatatctagtgtatctggcaaaaaaatcaagctaaaaggtttttttttaaaaagatataaagatattacttttaatgttaaaatggatagtaattatcaatccaaaaacatcaactcagtggcttttaatcttgtaagagtaaagaaaaaattctgtttccgaattttattgtattttattgttttctaatgactattatgtcattcttatgggtagatattaatatctatgtgcaaacccgttcctgtgttgttgggttgttatgaggaccaaatgagttaatataagcttttagaacagtgccttgcttagtatgttactttgctgaggctgccataacaaaatgccacagaacaggtggcttaaacaacagaagcgtattttctcacagttttagagcatggaaatccaagatcaaggtgtctggctattcttacatggacctttctgtgagcacacacactcctggtttgctgtcttcttcatgtgaggacaatagtcttacagaattaggccccactcttatgtcctcatttaatcttttttttttctttcttttttttttttttttttttgagacagagtctcgctctgtcgcccaggctggagtgctcacttcaacttccgcctcctgggttcaagtgattctcctgcctcagcctcctgagtacctgggactacaggcatgtgccaccatgcccagctcatttttgtattttttagtagagacggggtttcaccatgttggccagactagtctcaaactcctgatctcgtgatccgctagcctcggcctcccaacgtgctgggattataggtgtgagccaccatgtctggcctgtcctcatttaatcttatccctttaaagaccctctctccaaatacagtcacattctgaggtactaggagttagggcttcaacatacgaattttggagggggacatatattggtccacaatacttggtaaactttaggggctatcatcatcatcatcatcttcaatgacaacaacatcattatcactggaaaacactgtgccaatgcagtggcattggtaccaaggtaaaatacaaggaatttaaggacaaaaaaagaagacagaaacataaaaatattaataca

SEQ ID NO: 123442 - DNA, 759 bp, Homo sapiens
  Payload ID: 4241
  Gene Symbol: CCNC
  Gene Name: cyclin C
  ENST ID: ENST00000524049
  CDS Start-End: 274-759
cggattcttggtttagctaggccgcggggggtcggatagagtgggcacagtttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagaga

SEQ ID NO: 123443 - DNA, 674 bp, Homo sapiens
  Payload ID: 4241
  Gene Symbol: CCNC
  Gene Name: cyclin C
  ENST ID: ENST00000369217
  CDS Start-End: 97-674
gatcgaggagcgcggttaccggacgggctgggtctatggtcgctccgcgggccgctccgccggctggtgcttttttatcagggcaagctgtgttccatggcagggaacttttggcagagctcccactatcctaaaagaagggaccactttgccttgctcaaatcccttgagcagtcatggagtttcttatctggaaaaggtaacgagtgtggaagacaagacaattctggaaaaacaaacgaaaagattatgaaaggccattgtcttagtttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaat

SEQ ID NO: 123444 - DNA, 1152 bp, Homo sapiens
  Payload ID: 4241
  Gene Symbol: CCNC
  Gene Name: cyclin C
  ENST ID: ENST00000523961
  CDS Start-End: 120-269
gcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagctttt

SEQ ID NO: 123445 - DNA, 2473 bp, Homo sapiens
  Payload ID: 4241
  Gene Symbol: CCNC
  Gene Name: cyclin C
  Uniprot ID: P24863
  ENST ID: ENST00000520429
  CDS Start-End: 447-1298
aacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtatcgacta

SEQ ID NO: 123446 - DNA, 1035 bp, Homo sapiens
  Payload ID: 4241
  Gene Symbol: CCNC
  Gene Name: cyclin C
  Uniprot ID: P24863
  ENST ID: ENST00000523799
  CDS Start-End: 332-928
gaacactagttctcttcaatctcagcacctccaagggtcagcacctcccctccggctccctccgctaccgcgggccggaacttttgtcgataggaacgggtttgcacatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtc

SEQ ID NO: 123447 - DNA, 849 bp, Homo sapiens
  Payload ID: 4241
  Gene Symbol: CCNC
  Gene Name: cyclin C
  ENST ID: ENST00000486428
  CDS Start-End: 1-687
cttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatga

SEQ ID NO: 123448 - DNA, 958 bp, Homo sapiens
  Payload ID: 4241
  Gene Symbol: CCNC
  Gene Name: cyclin C
  Uniprot ID: P24863
  ENST ID: ENST00000523985
  CDS Start-End: 282-878
gtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactattatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacaca

SEQ ID NO: 123449 - DNA, 1426 bp, Homo sapiens
  Payload ID: 4241
  Gene Symbol: CCNC
  Gene Name: cyclin C
  ENST ID: ENST00000518714
  CDS Start-End: 136-984
ccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggtttttttttttttttgaagaacacttcttgtttttcataaatagtaggaataggattttatatgtaagatttaattttataggaaatttgtttagaagaagctgtaatctctatgttgagtgatacctgtaataacaatgaaatcccataccctaatttaaagtttttgagtatatatggacactaacttccagaatgcttgttatatgtgagggcacaaagttatataagaataaaaacataaaaccaa

SEQ ID NO: 123450 - DNA, 2186 bp, Homo sapiens
  Payload ID: 4241
  Gene Symbol: CCNC
  Gene Name: cyclin C
  ENST ID: ENST00000520371
  CDS Start-End: 187-1035
agtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataaggcaataatcctattgccaaagttactgtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcatagg

SEQ ID NO: 123451 - DNA, 1412 bp, Homo sapiens
  Payload ID: 4241
  Gene Symbol: CCNC
  Gene Name: cyclin C
  ENST ID: ENST00000484049
  CDS Start-End: 126-470
cgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttcttaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggtttttttttttttttgaagaacacttcttgtttttcataaatagtaggaataggattttatatgtaagatttaattttataggaaatttgtttagaagaagctgtaatctctatgttgagtgatacctgtaataacaatgaaatcccataccctaatttaaagtttttgagtatatatggacactaacttccagaatgcttgttatatgtgagggcacaaagttatataagaataaaaacataaaaccaa

SEQ ID NO: 123452 - DNA, 896 bp, Homo sapiens
  Payload ID: 4241
  Gene Symbol: CCNC
  Gene Name: cyclin C
  ENST ID: ENST00000627680
  CDS Start-End: 288-896
ctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagtaatagactaa

SEQ ID NO: 123453 - DNA, 3801 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000331242
  CDS Start-End: 327-2609
agcgggacagacgagcgggaggggcagcgtgcggggagctgggggcggggcgcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaa

SEQ ID NO: 123454 - DNA, 4038 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000394703
  CDS Start-End: 564-2846
aagtaagtgcgatggaaccttcaggttccaaccgccgccagggccgctccgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaa

SEQ ID NO: 123455 - DNA, 783 bp, Homo sapiens
  Payload ID: 4242
  Gene Symbol: DMTF1
  Gene Name: cyclin D binding myb-like transcription factor 1
  ENST ID: ENST00000449088
  CDS Start-End: 374-783
actccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaac

SEQ ID NO: 123456 - DNA, 3954 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000447863
  CDS Start-End: 276-1133
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 123457 - DNA, 581 bp, Homo sapiens
  Payload ID: 4242
  Gene Symbol: DMTF1
  Gene Name: cyclin D binding myb-like transcription factor 1
  ENST ID: ENST00000434534
  CDS Start-End: 293-581
gctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcag

SEQ ID NO: 123458 - DNA, 585 bp, Homo sapiens
  Payload ID: 4242
  Gene Symbol: DMTF1
  Gene Name: cyclin D binding myb-like transcription factor 1
  ENST ID: ENST00000453049
  CDS Start-End: 314-585
cactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgc

SEQ ID NO: 123459 - DNA, 610 bp, Homo sapiens
  Payload ID: 4242
  Gene Symbol: DMTF1
  Gene Name: cyclin D binding myb-like transcription factor 1
  ENST ID: ENST00000446796
  CDS Start-End: 356-610
gtttccggtggctcgtcgcgctcgctcactccagctgcagccactctcgcccgtggctgcttcctccatcctggtattttttggagcttccatcctggttcttccaaagtgcccggacccaaaacaggaaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagcttt

SEQ ID NO: 123460 - DNA, 3548 bp, Homo sapiens
  Payload ID: 4242
  Gene Symbol: DMTF1
  Gene Name: cyclin D binding myb-like transcription factor 1
  ENST ID: ENST00000413276
  CDS Start-End: 279-2351
ggcgcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaagattt

SEQ ID NO: 123461 - DNA, 568 bp, Homo sapiens
  Payload ID: 4242
  Gene Symbol: DMTF1
  Gene Name: cyclin D binding myb-like transcription factor 1
  ENST ID: ENST00000420131
  CDS Start-End: 538-568
gctcgtcgcgctcgctcactccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatg

SEQ ID NO: 123462 - DNA, 4460 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000412139
  CDS Start-End: 823-1641
ctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtctt

SEQ ID NO: 123463 - DNA, 1158 bp, Homo sapiens
  Payload ID: 4242
  Gene Symbol: DMTF1
  Gene Name: cyclin D binding myb-like transcription factor 1
  ENST ID: ENST00000454008
  CDS Start-End: 1-530
tgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttact

SEQ ID NO: 123464 - DNA, 627 bp, Homo sapiens
  Payload ID: 4242
  Gene Symbol: DMTF1
  Gene Name: cyclin D binding myb-like transcription factor 1
  ENST ID: ENST00000414630
  CDS Start-End: 481-627
gtcgcgctcgctcactccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacct

SEQ ID NO: 123465 - DNA, 3868 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000425406
  CDS Start-End: 262-996
gtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgtttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagaaaaaggcaattgctgcctgtttttttttcacccacagacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgatggtggtctgtcggagaatcaatgttctttttgtctacccatctcccttcagtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtctt

SEQ ID NO: 123466 - DNA, 2411 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000432937
  CDS Start-End: 367-2385
actctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttca

SEQ ID NO: 123467 - DNA, 572 bp, Homo sapiens
  Payload ID: 4242
  Gene Symbol: DMTF1
  Gene Name: cyclin D binding myb-like transcription factor 1
  ENST ID: ENST00000448598
  CDS Start-End: 425-572
actccagctgcagccactctcgcccgtggctgcttcctccatcctggtattttttggagcttccatcctggttcttccaaagtgcccggacccaaaacaggaaaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctc

SEQ ID NO: 123468 - DNA, 533 bp, Homo sapiens
  Payload ID: 4242
  Gene Symbol: DMTF1
  Gene Name: cyclin D binding myb-like transcription factor 1
  ENST ID: ENST00000428819
  CDS Start-End: 452-533
actccagctgcagccactctcgcccgtggctgcttcctccatcctggtattttttggagcttccatcctggttcttccaaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagccatgagatgctatattctgagactagttattccatctgtctgaacaagaggaaaataatatttgtgtaaaatagcagatttgagtatgagcacagtggaagaggattctgacacagtaacagtagaaactgtgaactctgtgactttgactcaggacacagaaggga

SEQ ID NO: 123469 - DNA, 545 bp, Homo sapiens
  Payload ID: 4242
  Gene Symbol: DMTF1
  Gene Name: cyclin D binding myb-like transcription factor 1
  ENST ID: ENST00000423590
  CDS Start-End: 426-545
aaaacaggaaaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaa

SEQ ID NO: 123470 - DNA, 557 bp, Homo sapiens
  Payload ID: 4242
  Gene Symbol: DMTF1
  Gene Name: cyclin D binding myb-like transcription factor 1
  ENST ID: ENST00000432366
  CDS Start-End: 339-557
aaagtgcccggacccaaaacaggaattgataggctcaccccaaaatatgcttttggggactgatttagcacctgcatattctgcgtgaatctctttaattggttgcagttgagctaatggtggagccaaaatgctattgccctgtcttcatcaacatttaatcactcctttatgtctccaaatgatacaagaagacccgagaaagtgagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagtt

SEQ ID NO: 123471 - DNA, 637 bp, Homo sapiens
  Payload ID: 4242
  Gene Symbol: DMTF1
  Gene Name: cyclin D binding myb-like transcription factor 1
  ENST ID: ENST00000430405
  CDS Start-End: 112-637
actccagctgcagccactctcgcccgtggctgcttcctccatcctggtattttttggagcttccatcctggttcttccaaagtgcccggacccaaaacaggaaatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcg

SEQ ID NO: 123472 - DNA, 980 bp, Homo sapiens
  Payload ID: 4242
  Gene Symbol: DMTF1
  Gene Name: cyclin D binding myb-like transcription factor 1
  ENST ID: ENST00000425705
  CDS Start-End: 407-980
ttttttttttttttttcagagaacgtttgtctgcctgatgagagccacttgggttaagaaactacctgtgaatagtcatcatttctgtccttcattggggaatacttttagaggccagtttccaaaaattctgcttaaaaaagaattctggttttgtcttactcttccagatgagatatcacagaggcttgggcctagattgtcatcagcatactgctatactattcgtttgttcttattaagccttattgtgtgtaatgctgttactttttcagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaa

SEQ ID NO: 123473 - DNA, 3657 bp, Homo sapiens
  Payload ID: 4242
  Gene Symbol: DMTF1
  Gene Name: cyclin D binding myb-like transcription factor 1
  ENST ID: ENST00000547146
  CDS Start-End: 117-1253
cgctcactccagctgcagccactctcgcccgtggctgcttcctccatcctggtattttttggagcttccatcctggttcttccaaagtgcccggacccaaaacaggaaatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcagtgggtttagtgctcatgcaaagtaccagattgaaggcgtggagactgaagtcctctctatatccacagaacaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 123474 - DNA, 770 bp, Homo sapiens
  Payload ID: 4242
  Gene Symbol: DMTF1
  Gene Name: cyclin D binding myb-like transcription factor 1
  ENST ID: ENST00000582925
  CDS Start-End: 667-770
aacctcaaatcatgtgcttttttttttttttaaggtctttggttggcttttgaggataaagatgagaagcttattgaaagaaacctttaaaaaccatttcatatttcataaagtttcacattgctttcaagagcttgtaatttgtcttttctggcctaattgtttaaggttttgtttttgttttttccacagattcctagatagggttgttcatctgtcatcttaaaagggttttctggatgaatagggtactatataatttttaatgctttaagataaaacataaagaggtgttaataattataaaggaaaactatagttactaataatatttatggtgctgtattgattgatatacacatcatgttacataatggtaccacagtctacagttcatagaatcactagcatagctgagcctgttttttttttttttttcagagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctca

SEQ ID NO: 123475 - DNA, 587 bp, Homo sapiens
  Payload ID: 4242
  Gene Symbol: DMTF1
  Gene Name: cyclin D binding myb-like transcription factor 1
  ENST ID: ENST00000582204
  CDS Start-End: 1-537
ccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacaggtactgtaatataatacttactatgtgcctgataaattttagatggaaaaaaacagacatttaa

SEQ ID NO: 123476 - DNA, 3483 bp, Homo sapiens
  Payload ID: 4242
  Gene Symbol: DMTF1
  Gene Name: cyclin D binding myb-like transcription factor 1
  ENST ID: ENST00000579850
  CDS Start-End: 238-1335
ctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgtttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaa

SEQ ID NO: 123477 - DNA, 579 bp, Homo sapiens
  Payload ID: 4242
  Gene Symbol: DMTF1
  Gene Name: cyclin D binding myb-like transcription factor 1
  ENST ID: ENST00000579592
  CDS Start-End: 532-579
ttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagttgataggctcaccccaaaatatgcttttggggactgatttagcacctgcatattctgcgtgaatctctttaattggttgcagttgagctaatggtggagccaaaatgctattgccctgtcttcatcaacatttaatcaagaacgtttgtctgcctgatgagagccacttgggttaagaaactacctgtgaatagtcatcatttctgtccttcattggggaatacttttagagagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtg

SEQ ID NO: 123478 - DNA, 1645 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000584619
  CDS Start-End: 190-1008
ggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgcttcagcagactctcctgctaccgttgactcagaaacaataacactaaacagtggaacactacagacatttgagattcttccc

SEQ ID NO: 123479 - DNA, 3915 bp, Homo sapiens
  Payload ID: 4242
  Gene Symbol: DMTF1
  Gene Name: cyclin D binding myb-like transcription factor 1
  Uniprot ID: Q9Y222
  ENST ID: ENST00000579677
  CDS Start-End: 276-1094
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggaacaactgtggaccccaaaaaaaggccacactttcaaactttggctctcaaagtattgctgcccacaacttccaaaccagtcaaatgggaagaagaagaatgaagaataaatgatgaaattaaaagggagaaaacaattgaaccaaatgctgattggcagactcttgttttaggctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaa

SEQ ID NO: 123480 - DNA, 4307 bp, Homo sapiens
  Payload ID: 4243
  Gene Symbol: CCND1
  Gene Name: cyclin D1
  Uniprot ID: P24385
  ENST ID: ENST00000227507
  CDS Start-End: 228-1115
gcttaacaacagtaacgtcacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 123481 - DNA, 553 bp, Homo sapiens
  Payload ID: 4243
  Gene Symbol: CCND1
  Gene Name: cyclin D1
  ENST ID: ENST00000536559
  CDS Start-End: 109-312
cgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggtaagtgagggtgatgtcccaggcagccttgccggggcttacagggggagacacctagtgccacggaaatgccgaggctggtgccaaggcccccaagg

SEQ ID NO: 123482 - DNA, 6480 bp, Homo sapiens
  Payload ID: 4244
  Gene Symbol: CCND2
  Gene Name: cyclin D2
  Uniprot ID: P30279
  ENST ID: ENST00000261254
  CDS Start-End: 270-1139
agagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacct

SEQ ID NO: 123483 - DNA, 529 bp, Homo sapiens
  Payload ID: 4244
  Gene Symbol: CCND2
  Gene Name: cyclin D2
  ENST ID: ENST00000536537
  CDS Start-End: 1-511
ccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttga

SEQ ID NO: 123484 - DNA, 2233 bp, Homo sapiens
  Payload ID: 4245
  Gene Symbol: CCND3
  Gene Name: cyclin D3
  ENST ID: ENST00000372987
  CDS Start-End: 521-1249
acttccagtgcgtgcagcgggagatcaagccgcacatgcggaagatgctggcttactggatgctggaggtaccgcccggacgcgtccccctcccccaccgctcccgggtctggacacaccggggccgccctgtcgggacatcccggtccccacagcaatctgcaggatgctccgaggctaagactcccggggcctggcctttcactagggcacccacgccagctgcctcccttgctttcccgagccctaatcggctcctcccgacagtgactgccagtcacttggcaccctaactgtgcctctcttcgggccgagcaaacgggaccaaggacactctctccccttcggcttctcacagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 123485 - DNA, 2133 bp, Homo sapiens
  Payload ID: 4245
  Gene Symbol: CCND3
  Gene Name: cyclin D3
  Uniprot ID: P30281
  ENST ID: ENST00000372988
  CDS Start-End: 514-1149
ggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 123486 - DNA, 2085 bp, Homo sapiens
  Payload ID: 4245
  Gene Symbol: CCND3
  Gene Name: cyclin D3
  Uniprot ID: P30281
  ENST ID: ENST00000372991
  CDS Start-End: 200-1078
attccacggttgctacatcgtcgcgaggggcggggcgcctgtcagggaagcggcgcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgga

SEQ ID NO: 123487 - DNA, 1724 bp, Homo sapiens
  Payload ID: 4245
  Gene Symbol: CCND3
  Gene Name: cyclin D3
  Uniprot ID: P30281
  ENST ID: ENST00000414200
  CDS Start-End: 107-769
gcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatca

SEQ ID NO: 123488 - DNA, 1843 bp, Homo sapiens
  Payload ID: 4245
  Gene Symbol: CCND3
  Gene Name: cyclin D3
  Uniprot ID: P30281
  ENST ID: ENST00000415497
  CDS Start-End: 569-859
acctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaat

SEQ ID NO: 123489 - DNA, 490 bp, Homo sapiens
  Payload ID: 4245
  Gene Symbol: CCND3
  Gene Name: cyclin D3
  ENST ID: ENST00000514588
  CDS Start-End: 351-490
aaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagcgtctcccgcttccctccgcctcccggccttctccggagagcgcgcctggaaaaccctgggctcggccgcccccgcccgggagccggttcctgtgtctttcgcggggttctggcggggaaggcgatgggggtggcgcgcgccctgttccggccgacagggaaatgaaaagtgcaggaggcagcggcaggagcctcctcccttcccctcgggtatgtgaggagcagcgctgtgaggaggaagtcttccccctggccatgaactacctggatcgctacctgtcttgcgtccccacccgaaaggc

SEQ ID NO: 123490 - DNA, 876 bp, Homo sapiens
  Payload ID: 4245
  Gene Symbol: CCND3
  Gene Name: cyclin D3
  ENST ID: ENST00000512426
  CDS Start-End: 1-528
gtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggtgagtgctgggtagctgggcagcagcctctccattcataaagtagtgctatgccctgagcctccagtagagggaaacctccaaccccaacctggtcccaagtcctggtttcacaaccttggggctttgtggctttttatctcctgccttggtctggggaagagcaagtatcttgggtggggtgaagggcactggccctaggggttcttttcttgccaagtggtgtgctggagtgggggtggggggtttggtgtcagatgcagggctgctctcacactcccttgccacatcctcttgctagtttctgagaactaaagagcgattcctggggccgggctgtggcctaacctccccagacttccc

SEQ ID NO: 123491 - DNA, 574 bp, Homo sapiens
  Payload ID: 4245
  Gene Symbol: CCND3
  Gene Name: cyclin D3
  ENST ID: ENST00000508143
  CDS Start-End: 545-574
aaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagctccaacctgagcggcaagacccagatggacatgggcacctaggggctttggggcagcactggtttaccacgtgtccctccatatcctgaagatgtaggcctccgtggacacacctgtattcctgagctgtgcatggcctctgtcctggttgcacagaggattggacccacagggcagatgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggc

SEQ ID NO: 123492 - DNA, 544 bp, Homo sapiens
  Payload ID: 4245
  Gene Symbol: CCND3
  Gene Name: cyclin D3
  ENST ID: ENST00000502771
  CDS Start-End: 414-544
acacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagctccaacctgagcggcaagacccagatggacatgggcacctaggggctttggggcagcactggtttaccacgtgtccctccatatcctgaagatgtaggcctccgtggacacacctgtattcctgagctgtgcatggcctctgtcctggttgcacagaggattggacccacagggcagatgggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtg

SEQ ID NO: 123493 - DNA, 540 bp, Homo sapiens
  Payload ID: 4245
  Gene Symbol: CCND3
  Gene Name: cyclin D3
  ENST ID: ENST00000505064
  CDS Start-End: 187-540
tttattggtccttgtctctctaagtagcttaccctctctgccgtttttgctccctatcccacctcacttcagcgctcccacccccccgctgctgtgttccccacgctccagacccagcagtgactgtgcgccctcccccaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccg

SEQ ID NO: 123494 - DNA, 1257 bp, Homo sapiens
  Payload ID: 4245
  Gene Symbol: CCND3
  Gene Name: cyclin D3
  ENST ID: ENST00000510503
  CDS Start-End: 254-841
cggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacaggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtcc

SEQ ID NO: 123495 - DNA, 2394 bp, Homo sapiens
  Payload ID: 4245
  Gene Symbol: CCND3
  Gene Name: cyclin D3
  Uniprot ID: P30281
  ENST ID: ENST00000511642
  CDS Start-End: 753-1388
cacaggctagagtgcaatggcgcgatctcggttcactgcaacctccacctcccaggctcaagcgatcctcccgcctcagcctccggagtagctgggattacaggcgggcaccaccacgccccgctagtttttgtatttttagtagagaccgagtttcgccatgttggccaggctggtctcgaacacctaagctcaagcagtccgcggcctcggcctcacaaggtgctgggattacaggcgtgagctaccgcgccagcctcacgtgaccttttgagagtgaagtgttctggggccttcagtggcttggttgtgggccaggaaaacgcgcccggtttcactgagttaaaagaaacctattttaatatgaaaatcggttcttataaagagcataccaggagatcatctacactcgcagggttttccaaacttgtcttattattagtaacacctggctgggcccagcccaatcccagtgacttcactctctggaagaggggcttgggaatctttctcattaaggagctccccagatgattcttctgagcgagtaatgttgggaaaccctggagcatccagcctggtgattttgtgctgagggccgccccgcctgtcaatggcccacttggaagtagagcctggaccacctagtccaagtctatcgctgcatcctgctgccttcgcgccctcgacccgcaagtatttgcgaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgg

SEQ ID NO: 123496 - DNA, 2047 bp, Homo sapiens
  Payload ID: 4245
  Gene Symbol: CCND3
  Gene Name: cyclin D3
  Uniprot ID: P30281
  ENST ID: ENST00000616010
  CDS Start-End: 751-1041
acctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggagctccaacctgagcggcaagacccagatggacatgggcacctaggggctttggggcagcactggtttaccacgtgtccctccatatcctgaagatgtaggcctccgtggacacacctgtattcctgagctgtgcatggcctctgtcctggttgcacagaggattggacccacagggcagatgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagcctctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgcccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacataatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttcttgg

SEQ ID NO: 123497 - DNA, 3660 bp, Homo sapiens
  Payload ID: 4246
  Gene Symbol: CCNDBP1
  Gene Name: cyclin D-type binding-protein 1
  Uniprot ID: O95273
  ENST ID: ENST00000300213
  CDS Start-End: 243-1325
cggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaatgagtgcccttccaaagtttctttttaccagaaatacagtggattgagactagaacattgctttcatttgggtttgtaggtttaaaaatctgattctaatcagaagtatatttagaacaaaacactttatttataaaagatgactccaaaattcatcttagtatttcaccatgttatatattattatcagcaagtccttctgaatattatcacagattactccatgtctctaaaatatattggcattgagctcatttgttaggtttgcccaccttattgaacagatttattttccttatacatacttgtgttgtccttggttacgtgtgtccccaaatgtaaataccaaatttttataaatcaaaaattttttagtgtgtaagagattttatgtaattttaagggccttttcagttcatccttttgcaaaaccatcaccacttaattatacttttgcatcagtctagaagactgcatattggaaagcagtgtaaatctataatgatgtatattctggtgagctgaatagggcattatgcatgtcctacaggtctccgccacctctcatgcccatcatcttccttttgtaggtgtaattcataacatatgcctttctgctgtctttaggtataatcagcaacagcagtcattctttgagtgactaatgtatacttggggttggggttgaaattccttaagccaaatgagttttagcttactgttttgaagtgccattttgtattgttaacaagtgtcatgaagggaaggaactaaaatcaaactgacagagtgtcaaggcaacaaaataacataaacaaaataataacattgtacaacagtctagttcttttatcctttcatatagagcctattttttatatacttttatatttctctactggaccaaattcatgttattaacatcagactttaattgtgggatacttaatgaatatagaactctaatataaagacttacctctagctgaattattctctcaggtcctgtattgtataacttcgttcagtcatgtttggatctttaaggataatgatcagggaaagcactgatcaatgtaatttttttttttttttttttttttttgagatggagtcttgctctgtcccccaagctggagtgcagtggcacactctcggctcactgcaacctccgcctcccaggttctcaagcaattctctggcttcagcctctcaagtagctgggactacagatgcacaccaccatgtccagctaatttttgtatttttagtagagatggggtttcaccatgttggccaggctggtctcaaactcctgacctcaggtgatctgcccacgtcagcctcccaaagtgctgggattacagatgtgagccaccgagcccagcttgatcaatgtaattttaagattacctaaaaattccattttgggataatatcccacttcatcagaaatattagaatgatttaagtgttaggtcctttcccttatctgtaagttaatgaatgtattaatgagcagtaaaatggttgcaaaaaacctgaacctgaacaatctgaatgtactccttaaaggtatctgagcaccttttcaacctgaatgactactcatttatctgataaagtgatgtagtttggatattcaaccctgcaaacctcatgctgaaattggattcccagtgttggaggtggggcctaatgggaggtgtttggatccctcatgaatggcttcgttccattggtggggtaatgagtaagttctcgctctatatgtccctcccccaccccagagctggctgttaaaacgaggctggcacctggcacttacccctacccctcaacccattcttgccctgtgatctctgctcacgttgcctcccttcatcttcctgcataagtggaagcagcctgaagccctcactgtttcttgtacagcctgcagagccgtgagccaaataaagctcttttcttttaaact

SEQ ID NO: 123498 - DNA, 736 bp, Homo sapiens
  Payload ID: 4246
  Gene Symbol: CCNDBP1
  Gene Name: cyclin D-type binding-protein 1
  ENST ID: ENST00000562553
  CDS Start-End: 54-242
ctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctag

SEQ ID NO: 123499 - DNA, 1831 bp, Homo sapiens
  Payload ID: 4246
  Gene Symbol: CCNDBP1
  Gene Name: cyclin D-type binding-protein 1
  Uniprot ID: O95273
  ENST ID: ENST00000565296
  CDS Start-End: 61-990
agtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcaggttacattttcctttttctgtccttttttaaattgaaaatattttagatctaaaaaatcttattaaaatgttatagcaatagtattaataagatcttgctaaatagaaaagaacccgtaatcctgccaccctaacctaatcagcattttaaattttgcatacttccttcaggtcctttttctaaataatttttttattacttgggtctttaaaaatatttgaactcacctttttatggtagggctcagggtgaataacttctgtgtttcttttctagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgatt

SEQ ID NO: 123500 - DNA, 1450 bp, Homo sapiens
  Payload ID: 4246
  Gene Symbol: CCNDBP1
  Gene Name: cyclin D-type binding-protein 1
  ENST ID: ENST00000563065
  CDS Start-End: 94-282
gacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgatt

SEQ ID NO: 123501 - DNA, 1385 bp, Homo sapiens
  Payload ID: 4246
  Gene Symbol: CCNDBP1
  Gene Name: cyclin D-type binding-protein 1
  ENST ID: ENST00000568507
  CDS Start-End: 61-489
agtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgct

SEQ ID NO: 123502 - DNA, 1634 bp, Homo sapiens
  Payload ID: 4246
  Gene Symbol: CCNDBP1
  Gene Name: cyclin D-type binding-protein 1
  Uniprot ID: O95273
  ENST ID: ENST00000566515
  CDS Start-End: 172-1101
ccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatg

SEQ ID NO: 123503 - DNA, 1356 bp, Homo sapiens
  Payload ID: 4246
  Gene Symbol: CCNDBP1
  Gene Name: cyclin D-type binding-protein 1
  ENST ID: ENST00000569745
  CDS Start-End: 95-223
tgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcggggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgtt

SEQ ID NO: 123504 - DNA, 713 bp, Homo sapiens
  Payload ID: 4246
  Gene Symbol: CCNDBP1
  Gene Name: cyclin D-type binding-protein 1
  ENST ID: ENST00000567434
  CDS Start-End: 91-219
gctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcggggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctag

SEQ ID NO: 123505 - DNA, 2043 bp, Homo sapiens
  Payload ID: 4247
  Gene Symbol: CCNE1
  Gene Name: cyclin E1
  Uniprot ID: P24864
  ENST ID: ENST00000262643
  CDS Start-End: 280-1512
gaggggctgggagccgcggcggggcggtgcgagggcgggccggggccggttccgcgcgcagggattttaaatgtcccgctctgagccgggcgcaggagcagccggcgcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttga

SEQ ID NO: 123506 - DNA, 1641 bp, Homo sapiens
  Payload ID: 4247
  Gene Symbol: CCNE1
  Gene Name: cyclin E1
  ENST ID: ENST00000357943
  CDS Start-End: 58-1110
gtgctcacccggcccggtgccacccgggtccacagggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctccacattatcagttgacagtgtacaatgcctttgatgaactgttttgtaagtgctgctatatctatccattttttaataaagataatactgtttttga

SEQ ID NO: 123507 - DNA, 1680 bp, Homo sapiens
  Payload ID: 4247
  Gene Symbol: CCNE1
  Gene Name: cyclin E1
  Uniprot ID: P24864
  ENST ID: ENST00000444983
  CDS Start-End: 58-1245
gtgctcacccggcccggtgccacccgggtccacagggatgcgaaggagcgggacaccatgaaggaggacggcggcgcggagttctcggctcgctccaggaagaggaaggcaaacgtgaccgtttttttgcaggatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaaggcccttaagtggcgtttaagtcccctgactattgtgtcctggctgaatgtatacatgcaggttgcatatctaaatgacttacatgaagtgctactgccgcagtatccccagcaaatctttatacagattgcagagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccagtgcgtgctcccgatgctgctatggaaggtgctacttgacctaagggactcccacaacaacaaaagcttgaagctgtggagggccacggtggcgtggctctcctcgcaggtgttctgggctccgttgtaccaagtggagcaggtggttgcgggcaagcgttgtgcagagcccatagccagctgggcagggggctgccctctcc

SEQ ID NO: 123508 - DNA, 820 bp, Homo sapiens
  Payload ID: 4247
  Gene Symbol: CCNE1
  Gene Name: cyclin E1
  ENST ID: ENST00000575243
  CDS Start-End: 174-820
gcggccgccagcgcggtgtagggggcaggcgcggatcccgccaccgccgcgcgctcggcccgccgactcccggcgccgccgccgccactgccgtcgccgccgccgcctgccgggactggagcgcgccgtccgccgcggacaagaccctggcctcaggccggagcagccccatcatgccgagggagcgcagggagcgggatgcgaaggagcgggacaccatgaaggaggacggcggcgcggagttctcggctcgctccaggaagaggaaggcaaacgtgaccgttgatccagatgaagaaatggccaaaatcgacaggacggcgagggaccagtgtgggagccagccttgggacaataatgcagtctgtgcagacccctgctccctgatccccacacctgacaaagaagatgatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatgg

SEQ ID NO: 123509 - DNA, 1085 bp, Homo sapiens
  Payload ID: 4247
  Gene Symbol: CCNE1
  Gene Name: cyclin E1
  ENST ID: ENST00000576532
  CDS Start-End: 1-852
gatgaccgggtttacccaaactcaacgtgcaagcctcggattattgcaccatccagaggctccccgctgcctgtactgagctgggcaaatagagaggaagtctggaaaatcatgttaaacaaggaaaagacatacttaagggatcagcactttcttgagcaacaccctcttctgcagccaaaaatgcgagcaattcttctggattggttaatggaggtgtgtgaagtctataaacttcacagggagaccttttacttggcacaagatttctttgaccggtatatggcgacacaagaaaatgttgtaaaaactcttttacagcttattgggatttcatctttatttattgcagccaaacttgaggaaatctatcctccaaagttgcaccagtttgcgtatgtgacagatggagcttgttcaggagatgaaattctcaccatggaattaatgattatgaagctgttggatctctgtgtcctggatgttgactgccttgaatttccttatggtatacttgctgcttcggccttgtatcatttctcgtcatctgaattgatgcaaaaggtttcagggtatcagtggtgcgacatagagaactgtgtcaagtggatggttccatttgccatggttataagggagacggggagctcaaaactgaagcacttcaggggcgtcgctgatgaagatgcacacaacatacagacccacagagacagcttggatttgctggacaaagcccgagcaaagaaagccatgttgtctgaacaaaatagggcttctcctctccccagtgggctcctcaccccgccacagagcggtaagaagcagagcagcgggccggaaatggcgtgaccaccccatccttctccaccaaagacagttgcgcgcctgctccacgttctcttctgtctgttgcagcggaggcgtgcgtttgcttttacagatatctgaatggaagagtgtttcttccacaacagaagtatttctgtggatggcatcaaacagggcaaagtgttttttattgaatgcttataggttttttttaaataagtgggtcaagtacaccagccacctccagacaccag

SEQ ID NO: 123510 - DNA, 2724 bp, Homo sapiens
  Payload ID: 4248
  Gene Symbol: CCNE2
  Gene Name: cyclin E2
  Uniprot ID: O96020
  ENST ID: ENST00000308108
  CDS Start-End: 105-1319
gtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagt

SEQ ID NO: 123511 - DNA, 1361 bp, Homo sapiens
  Payload ID: 4248
  Gene Symbol: CCNE2
  Gene Name: cyclin E2
  ENST ID: ENST00000396133
  CDS Start-End: 105-1229
gtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctgtgcatgatttcttcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaa

SEQ ID NO: 123512 - DNA, 592 bp, Homo sapiens
  Payload ID: 4248
  Gene Symbol: CCNE2
  Gene Name: cyclin E2
  ENST ID: ENST00000521809
  CDS Start-End: 49-276
ccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaag

SEQ ID NO: 123513 - DNA, 3330 bp, Homo sapiens
  Payload ID: 4248
  Gene Symbol: CCNE2
  Gene Name: cyclin E2
  Uniprot ID: O96020
  ENST ID: ENST00000520509
  CDS Start-End: 254-1468
ccgcgaggctccgtctccccggcgcggcccgctcgccgtccggctcgctcagggcctgggcagacgcggcccgcccgagctaccgcgggttccgagacgccttcgcactgctcctccacccgggggatctttgttcccggagctgttccccgcctcgctgctcccgccgcaaaacctgtttgcggaatacccgccgcaagtctgacttgacgatgtgcagttttgggaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaagttttgccattgcttggagaaacttttttttccttctctgcgctgccagctgtaacacttcttctggattgcttgcattcaactctgtctggccgatggctttgatcttccaaaacagaaaagtgatgttattagaggtgtgtcaaaaattaagttttgttggtacaagtaatataaagctacctacgtgctaacaacgatacagtttaatgattaactgaacctcttaactgtaaaacccaggagtcttggaaaaaaattaacataaagattaaccagggccactctcaaggaaagatggactgctgagccatagtttatggaattacttaagtggcattttaatatattaagtaaattcatgtaaatttatttgaaagtataagtaagctctacatggcgatttttagagttaaactagggctccacttgttaatgtgcaaaaataactggt

SEQ ID NO: 123514 - DNA, 625 bp, Homo sapiens
  Payload ID: 4248
  Gene Symbol: CCNE2
  Gene Name: cyclin E2
  ENST ID: ENST00000524224
  CDS Start-End: 1-458
tggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagctcttctcccatttctcctaccttctggaccaatgaggacaaacagaattgaagtttaattccactgcacaagtatcttctcaaatctgtgaaatctaccccttttacactataccattccactgctactagttcagctcttattgcctagattatacagccttttaactaatctcactgcttaataaacatgttttcttcta

SEQ ID NO: 123515 - DNA, 434 bp, Homo sapiens
  Payload ID: 4248
  Gene Symbol: CCNE2
  Gene Name: cyclin E2
  ENST ID: ENST00000519889
  CDS Start-End: 52-237
gagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccagtttaccaatggtcttttctattttccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaa

SEQ ID NO: 123516 - DNA, 1733 bp, Homo sapiens
  Payload ID: 4248
  Gene Symbol: CCNE2
  Gene Name: cyclin E2
  ENST ID: ENST00000611101
  CDS Start-End: 164-1054
gagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtacc

SEQ ID NO: 123517 - DNA, 4173 bp, Homo sapiens
  Payload ID: 4249
  Gene Symbol: CCNF
  Gene Name: cyclin F
  ENST ID: ENST00000293968
  CDS Start-End: 89-268
ctgcgcctgcgcgagggctacgcgcgctccggccggggcgcgggcgcgctctcaggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtg

SEQ ID NO: 123518 - DNA, 4283 bp, Homo sapiens
  Payload ID: 4249
  Gene Symbol: CCNF
  Gene Name: cyclin F
  Uniprot ID: P41002
  ENST ID: ENST00000397066
  CDS Start-End: 89-2449
ctgcgcctgcgcgagggctacgcgcgctccggccggggcgcgggcgcgctctcaggcgggctccggcggcagcgacgcgagcgcggcgatggggagcggcggcgtggtccactgtaggtgtgccaagtgtttctgttatcctacaaagcgaagaataaggaggaggccccgaaacctgaccatcttgagtctccccgaagatgtgctctttcacatcctgaaatggctttctgtagaggacatcctggccgtccgagctgtacactcccagctgaaggacctggtggacaaccacgccagtgtgtgggcatgtgccagcttccaggagctgtggccgtctccagggaacctgaagctctttgaaagggctgctgaaaaggggaatttcgaagctgctgtgaagctgggcatagcctacctctacaatgaaggcctgtctgtgtctgatgaggcccgcgcagaagtgaatggcctgaaggcctctcgcttcttcagtctcgctgagcggctgaatgtgggtgccgcacctttcatctggctcttcatccgccctccgtggtcggtgagcggaagctgctgcaaggccgtggttcacgagagcctcagggcagagtgccagctgcagaggactcacaaagcatccatattgcactgcttgggcagagtgctgagtctgttcgaggatgaggagaagcagcagcaggcccatgacctgtttgaggaggctgctcatcagggatgtctgaccagctcctacctcctctgggaaagcgacaggaggacagatgtgtcagatcctgggcgatgcctccacagcttccgaaaactcagggactacgctgccaaaggctgctgggaagcgcagctgtctttagccaaagcctgtgcaaatgcaaaccagcttggactggaggtgagagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgagtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatgaagacctcattccctgcgtcttgagcctccataagaagtgcttccatgatgacgcccccaaggactacaggcaagtctctctgaccgccgtgaagcagcggtttgaggacaagcgctatggagaaatcagccaggaagaggtgctgagctacagccagttgtgtgctgcattaggagtgacacaagacagccccgaccccccgactttcctcagcacaggggagatccacgccttcctcagctctccctcggggcggagaaccaaacggaagcgggagaacagcctccaggaagacagaggcagcttcgttaccacccccactgcggagctgtccagccaggaggagacgctgctgggcagcttcctcgactggagcctggactgctgctctggctatgaaggcgaccaggagagtgagggcgagaaggagggcgacgtgacagctcccagcggcatcctcgatgtcaccgtggtctacctgaacccagaacagcattgctgccaggaatccagtgatgaggaggcttgtccagaggacaagggaccccaggacccacaggcactggcgctggacacccagatccctgcaacccctggacccaaacccctggtccgcaccagccgggagccagggaaggacgtcacgacctcagggtactcctccgtcagcaccgcaagtcccacaagctccgtggacggtggcttgggggccctgccccaacctacctcagtgctgtccctggacagtgactcgcacacacagccctgccaccatcaggccaggaagtcatgtttacagtgtcgtcccccaagtcccccggagagcagtgttccccagcaacaggtgaagcggataaacctatgcatacacagtgaggaggaggacatgaacctgggccttgtgaggctgtaagtgtgtcagcacatttgccgcagtggatgtgtactgagggggctggaggcgaagggtgggagcatagcataggaacgctgcatagaccatggaggcctttgcgcagagagcagagaggatgacttgcggccaccaagtttctgtctccgcgggagtcccgtgcaagccatcagaatgttgaaatgagggtgaagagctcagatccctctctttggaaagtttagcctggaagcagttggccacactgtgtggagggcacctctctgtcccttccgtgtctcactgtctctggaagcttcagcccatgtgtgtcctggtgttcccagccccaccagagccccgtgccgggagctgacagctttcacgcttaaggcacgtgtgacctgggtagtcagacaccacttgagcccctgcccacatctgctggtttggggcttcagtggggagctgacagctgtgagcacaccactgtcccctcatccacctcggcctgcatggggcacccacttccttctgggtggggcttccatggtaagggggcctgcgtccctgcacactgcgaggactgccttggccacaggcccactccctacgacacgtgactcgttttagagctctgtcccagaggcgttcgtatgtgacccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtggca

SEQ ID NO: 123519 - DNA, 789 bp, Homo sapiens
  Payload ID: 4249
  Gene Symbol: CCNF
  Gene Name: cyclin F
  ENST ID: ENST00000564236
  CDS Start-End: 1-560
gagcttccagtgagatcgtctgccagctatttcaggcttcccaggctgtcagtaaacaacaagtcttctccgtgcagaagggactcaatgacacaatgaggtacattctgatcgactggctggtggaagttgccaccatgaaggacttcacaagcctgtgcctgcacctgaccgtggagtgtgtggaccggtacctgcggaggaggctggtgccgcggtacaggctccagctgctgggcatcgcctgcatggtcatctgcacccggtttatcagtaaagagatcctgaccatccgggaggccgtatggctcacggacaacacttacaagtacgaggacctggtgagaatgatgggcgagatcgtctccgccttggaagggaagattcgaccatggagcaggaggccacggttgcaccacgtcgccatctgcgctggtgcgctacgcgtgcagcatcggcgtgaacatcatccgggccagaccctgcgctgggcctgcatgcggcactgcaccaaggagcccccgagcgctgagagcccacaccccgtcccggctgtctaggtccccactgtggtggattacaaggaggtcctgctgacgctagtccctgtggagctgagaacccagcacctgtgcagcttcctctgcgagctctccctgctgcacaccagcctgtccgcctacgccccagcccgcctggctgccgcagccctgctcctggccagactgacgcacgggcagacacagccctggaccactcagctgtgggacctcaccggattctcctatg

SEQ ID NO: 123520 - DNA, 4442 bp, Homo sapiens
  Payload ID: 4250
  Gene Symbol: GAK
  Gene Name: cyclin G associated kinase
  Uniprot ID: O14976
  ENST ID: ENST00000314167
  CDS Start-End: 112-4047
gaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatg

SEQ ID NO: 123521 - DNA, 1768 bp, Homo sapiens
  Payload ID: 4250
  Gene Symbol: GAK
  Gene Name: cyclin G associated kinase
  ENST ID: ENST00000511980
  CDS Start-End: 1-1403
aggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaagacccccaagcccagagcacagtgagcccaaggggacagcgtgtctgcacctgttccaggcgactgccaactggcaagctaaaaccgggagttgctgacactggcactgctgccagcccccaccggcattgtggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggtt

SEQ ID NO: 123522 - DNA, 4280 bp, Homo sapiens
  Payload ID: 4250
  Gene Symbol: GAK
  Gene Name: cyclin G associated kinase
  Uniprot ID: O14976
  ENST ID: ENST00000511163
  CDS Start-End: 187-3885
aggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatg

SEQ ID NO: 123523 - DNA, 577 bp, Homo sapiens
  Payload ID: 4250
  Gene Symbol: GAK
  Gene Name: cyclin G associated kinase
  ENST ID: ENST00000512325
  CDS Start-End: 131-358
acgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcg

SEQ ID NO: 123524 - DNA, 568 bp, Homo sapiens
  Payload ID: 4250
  Gene Symbol: GAK
  Gene Name: cyclin G associated kinase
  ENST ID: ENST00000511229
  CDS Start-End: 358-568
agatgccgtctatcaggctggggaggtttctttctgtcctcgtttgctgagagttttaaatttcatgatgtagtttttccactgcagaaacctaaaagaaaactaagcaaattagaccccaaaacaatagaattaaattgattttcaaatgttaaaccaactctgctcctgatgtcttggtgggcttggtttgctgttttatgaagaattcttgggtccacattcgtgagtgatgttggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccg

SEQ ID NO: 123525 - DNA, 929 bp, Homo sapiens
  Payload ID: 4250
  Gene Symbol: GAK
  Gene Name: cyclin G associated kinase
  ENST ID: ENST00000504668
  CDS Start-End: 1-210
cccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatga

SEQ ID NO: 123526 - DNA, 554 bp, Homo sapiens
  Payload ID: 4250
  Gene Symbol: GAK
  Gene Name: cyclin G associated kinase
  ENST ID: ENST00000502656
  CDS Start-End: 141-554
acgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcag

SEQ ID NO: 123527 - DNA, 763 bp, Homo sapiens
  Payload ID: 4250
  Gene Symbol: GAK
  Gene Name: cyclin G associated kinase
  ENST ID: ENST00000510799
  CDS Start-End: 1-763
gctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggcc

SEQ ID NO: 123528 - DNA, 468 bp, Homo sapiens
  Payload ID: 4250
  Gene Symbol: GAK
  Gene Name: cyclin G associated kinase
  ENST ID: ENST00000507580
  CDS Start-End: 131-280
acgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggttgagaacttgttgcttagtaaccaagggaccattaagctgtgtgactttggcagtgccacgaccatctcgcactaccctgactacagctggagcgcccagaggcgagccctggtggaggaagaggccctgggctgcatcttgtacctgctgtgcttccggcagcacccttttgaggatggagcgaaacttc

SEQ ID NO: 123529 - DNA, 1326 bp, Homo sapiens
  Payload ID: 4250
  Gene Symbol: GAK
  Gene Name: cyclin G associated kinase
  ENST ID: ENST00000505819
  CDS Start-End: 179-535
gggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatc

SEQ ID NO: 123530 - DNA, 1248 bp, Homo sapiens
  Payload ID: 4250
  Gene Symbol: GAK
  Gene Name: cyclin G associated kinase
  ENST ID: ENST00000618573
  CDS Start-End: 1-1248
atgtcgctgctgcagtcggcgctcgacttcttggcgggtccaggctccctgggcggtgcttccggccgcgaccagagtgacttcgtggggcagacggtggaactgggcgagctgcggctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttc

SEQ ID NO: 123531 - DNA, 497 bp, Homo sapiens
  Payload ID: 4250
  Gene Symbol: GAK
  Gene Name: cyclin G associated kinase
  ENST ID: ENST00000628912
  CDS Start-End: 141-497
acgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgctctgttcactcggagagcccgccggctgcctgagtgtgggttcgggtggacacagccacgccgcagcctccctgcgcacagccccctga

SEQ ID NO: 123532 - DNA, 2458 bp, Homo sapiens
  Payload ID: 4251
  Gene Symbol: CCNG1
  Gene Name: cyclin G1
  Uniprot ID: P51959
  ENST ID: ENST00000340828
  CDS Start-End: 225-1112
agggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaa

SEQ ID NO: 123533 - DNA, 2366 bp, Homo sapiens
  Payload ID: 4251
  Gene Symbol: CCNG1
  Gene Name: cyclin G1
  Uniprot ID: P51959
  ENST ID: ENST00000393929
  CDS Start-End: 135-1022
attcctcgttagggcaggcgcggccccttcggctccgagctgaccctgatcagggccgagttgtctcggcggcgctgccgaggcctccacccagggagggtggttaccgctgaggagctgcagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattc

SEQ ID NO: 123534 - DNA, 418 bp, Homo sapiens
  Payload ID: 4251
  Gene Symbol: CCNG1
  Gene Name: cyclin G1
  ENST ID: ENST00000511490
  CDS Start-End: 75-418
gagctgaccctgatcagggccgagttgtctcggcggcgctgccgaggcctccacccaggacagtctctgtcaagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgt

SEQ ID NO: 123535 - DNA, 994 bp, Homo sapiens
  Payload ID: 4251
  Gene Symbol: CCNG1
  Gene Name: cyclin G1
  ENST ID: ENST00000510664
  CDS Start-End: 269-772
ccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaagatgatagaggtactgacaacaactgactctcagaaactgctacaccagctgaatgccctgttggaacaggagtctagatgtcagccaaagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcc

SEQ ID NO: 123536 - DNA, 564 bp, Homo sapiens
  Payload ID: 4251
  Gene Symbol: CCNG1
  Gene Name: cyclin G1
  ENST ID: ENST00000510097
  CDS Start-End: 157-564
cccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgaga

SEQ ID NO: 123537 - DNA, 919 bp, Homo sapiens
  Payload ID: 4251
  Gene Symbol: CCNG1
  Gene Name: cyclin G1
  Uniprot ID: P51959
  ENST ID: ENST00000512163
  CDS Start-End: 375-860
atattcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggattattacagcaccaaaaaacttctctgaagcctttctccacaaccttgttctat

SEQ ID NO: 123538 - DNA, 732 bp, Homo sapiens
  Payload ID: 4251
  Gene Symbol: CCNG1
  Gene Name: cyclin G1
  ENST ID: ENST00000504553
  CDS Start-End: 39-362
tccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggagaaatagcattaattttgaaagactagaagctcaactgaaggcatgtcattgcaggatcatattttctaaagcaaagccttctgtgttggcattgtctatcattgcattagagatccaagcacagaagtgtgtagagttaacagaaggaatagaatgtcttcagaaacattccaaggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattct

SEQ ID NO: 123539 - DNA, 5526 bp, Homo sapiens
  Payload ID: 4252
  Gene Symbol: CCNG2
  Gene Name: cyclin G2
  Uniprot ID: Q16589
  ENST ID: ENST00000316355
  CDS Start-End: 357-1391
aagtgcaggatccctccgcggggagtcacgtgccccgcccccttgggggcgtcgaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcccatgactgtgatgaataaaattgagaagcccctgcccttttcagagcagagggtgaggagaaagctaccattttgtcctcatccttacccccgttgacttggcgagagatttgacctttcaggttttgatcctgtcattttctaggatgtggtgcacgcactttgctgttgcgcatggtgaagtattgtgcctaggtcctgggtcttcatctgtttggctctgctactgtttcctcctcccaggaagtgtggttagacaaataatgtgttttaattacctgtcacactcaggattaatacatactcaggttaactgtagagaggcattggcttcagaacactcctcgtgacaattttaaccattttctttgtctagagtctgcctttttcttttttacaatttcttttatttcaacactaggtttcaatatggtgttcctgctacctcccacctccctcctccctcatcacacatgcaaattgtcagcttattgagacaacccacttagattcatatatggacaaggacaaggtattttgcatttgttactggaattcagttttcctaactatttactaccagaaatggtcaataacttactttgtgtttagcaaatcaaattgtgtgatagatagtttcccagtatgatggccagtcagtctttccatccctgtgcctacatgctgctcttcccgtccacaagtggagtctgtttctcttgagttttggctggccttatgaatggctttgcttactgaagtgcagcagaagaaatttagtatatgtccaagcctaggctttaagagactggcagctttccttttatcctttttggaagctagccaccatgctgcaaagaagctcagctggattactgaaagatgagaggccatgtggagagagactcttgaggatgagagattatcttggatgttccagccttaagctcccagctgaatgtgggtgtatcctcagctacaccacagaaaacagaggaactactcagtcgatcccaatcaacccacagactcactagaaataacaaattattgttttaagccacgaggttttgggggagggttgttaaacagtaatagataagtgagacagattgcttgttatttatggtcaaatggtgattatctctggtgagattacaggtgatgttttttttaagttatgcctatctgtagtttcctttttttcctaaaattgatttgaattattagtgtattaacagaataaagaatgaactttaaaacac

SEQ ID NO: 123540 - DNA, 1335 bp, Homo sapiens
  Payload ID: 4252
  Gene Symbol: CCNG2
  Gene Name: cyclin G2
  ENST ID: ENST00000354403
  CDS Start-End: 304-1335
gaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagctctgttgcccaggctggagtgcagtggcccgatctcagctcattccaacctccacctaccaggttcaagcgattctcatgcctcagcctccggagtagctgggattacaggtgctggtct

SEQ ID NO: 123541 - DNA, 1410 bp, Homo sapiens
  Payload ID: 4252
  Gene Symbol: CCNG2
  Gene Name: cyclin G2
  Uniprot ID: Q16589
  ENST ID: ENST00000395640
  CDS Start-End: 237-1271
ggtcttacccagcgctggccggcggacctgaccacggctcctccccctgccacacctccctggccgtggtggggattgccctggggctctggcggacgtgactggtcccttcacccgctccttgtcggggtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatc

SEQ ID NO: 123542 - DNA, 1459 bp, Homo sapiens
  Payload ID: 4252
  Gene Symbol: CCNG2
  Gene Name: cyclin G2
  Uniprot ID: Q16589
  ENST ID: ENST00000502280
  CDS Start-End: 165-1199
cttaacaaaaacaaggggctcggggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacgatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttgggg

SEQ ID NO: 123543 - DNA, 578 bp, Homo sapiens
  Payload ID: 4252
  Gene Symbol: CCNG2
  Gene Name: cyclin G2
  ENST ID: ENST00000512918
  CDS Start-End: 97-578
ctggccgtggtggggattgccctggggctctggcggacgtgactggtcccttcacccgctccttgtcggggtgtgctggggcgacccttgctggagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactt

SEQ ID NO: 123544 - DNA, 1549 bp, Homo sapiens
  Payload ID: 4252
  Gene Symbol: CCNG2
  Gene Name: cyclin G2
  Uniprot ID: Q16589
  ENST ID: ENST00000509972
  CDS Start-End: 108-1022
gtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagagagattccaacctcgagaaaaagggctgagtttgattgaggctaccccggagaatgataacactttgtgtccaggattgagaaatgccaaagttgaagatttaaggagtttagccaacttttttggatcttgcactgaaacttttgtcctggctgtcaatattttggacaggttcttggctcttatgaaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggaaagaaatactgagccttgataaactagaagctcagctgaaagcttgcaactgccgactcatcttttcaaaagcaaaaccatctgtattagccttgtgccttctcaatttggaagtggaaactttgaaatctgttgaattactggaaattctcttgctagttaaaaaacattccaagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtaggcaggttccttgactaattaaacttccctagactaaatattactgagtttattatactcagaactggaatagtgtaagacatcagagaaagcaagcacctacactaagagctaagaattaaagcccccactcttcaggtaagcaaattaaccagaagtagtattttaatatgtaatgatttataaggtcctctccaatttttttagtttttttcttttttatatttttttgagtagagatagggtctcgcgatgttgcccagggctggtcttacatactcccaggctcaagtgatcctcctgcctcagcctccgaagtgctgagattacaggtgtgagccactgcactcggcctcttttccctttttaaagtggttgttttccatctttctcctatttcccttgctcttgaaatacagctaaaaaaccccaaaaaaacaaaactgaaaaagaattctgggctttgtaatgttagtatgaattcctaatattgtgctgtggtgaagagattgaggggtaggtgcctgg

SEQ ID NO: 123545 - DNA, 1378 bp, Homo sapiens
  Payload ID: 4253
  Gene Symbol: CCNH
  Gene Name: cyclin H
  Uniprot ID: P51946
  ENST ID: ENST00000256897
  CDS Start-End: 226-1197
gggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 123546 - DNA, 1497 bp, Homo sapiens
  Payload ID: 4253
  Gene Symbol: CCNH
  Gene Name: cyclin H
  ENST ID: ENST00000504878
  CDS Start-End: 576-1325
gccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaaga

SEQ ID NO: 123547 - DNA, 2391 bp, Homo sapiens
  Payload ID: 4253
  Gene Symbol: CCNH
  Gene Name: cyclin H
  ENST ID: ENST00000508855
  CDS Start-End: 54-821
gcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatttccaaatgggtttttaaaaaaaaccagatatatgattttgaatagctgtctacatcaaactcttacgctagtatagataagtaggtagcagcaaattgtatattcagttgtggttgttttttaattttgttttgatgtaaggtcttgctatgttgcccaggctgtctcagactcctaggctctagtgatcctctgcctcagttttctgagtaattgggactacaggcacacatcaccacagccttataattaacctattagatcctataagtgaatccgtgtaagtagattataacagttactaggaattttgcagattaaatatgttagagaaatgtaattcaaattgaaatgagtcaatataaaaatatgaaagcacagactattacagcaaattacttacatatgaatcatggccagctgtatttcactatgtgaccttggtaagttattaaacctctaagtgccagtttcccacactgaaaatggggaagataaaaatgcctact

SEQ ID NO: 123548 - DNA, 2772 bp, Homo sapiens
  Payload ID: 4254
  Gene Symbol: CCNI
  Gene Name: cyclin I
  Uniprot ID: Q14094
  ENST ID: ENST00000237654
  CDS Start-End: 578-1711
cttcccctctcttcccctccctccccagccttccccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattgagcccatctcaacatttggcagtccttaccaagcaactacttcactgtatggcctgcaaccaacttctgcaattcagaggatccatgcttgctctggccatggttagtctggaaatggagaaactcattcctgattggctttctcttacaattgaactgcttcagaaagcacagatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagaaaaaaaaaataaaactctcattatttgtgtggctaattataattcagcgttatttaagcacataaagaccaaaaaaaaaaaaaagaaatccaaaagatccaaactttttttaaacttaaaaaatctctttgtagtatgtcagttgcactttttttctgccataatgtaacgtagcttgccccgtcaaaaattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtcct

SEQ ID NO: 123549 - DNA, 595 bp, Homo sapiens
  Payload ID: 4254
  Gene Symbol: CCNI
  Gene Name: cyclin I
  ENST ID: ENST00000507788
  CDS Start-End: 447-595
ctccctccccagccttccccgcgagcggacgcggcagcgcctctgtctcgctttttcttatttttcccccctttcccctttctttttttttttttcttttcttttctcccctccccccctttcaccatttcccctcggaggcgctttccccgggcaggggcagagccggtctcaccccccgcctctccccggcccccgccgccctatggcgagagggagccccctcccaacccgggctcgagcggcggcggcctcaggccgggggtcatcatggaactaattcgctgaccgacccagcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaagaatgtttctccatcccagagagatgaagtaattcaatggctggccaaactcaagtaccaattcaacctttacccaga

SEQ ID NO: 123550 - DNA, 576 bp, Homo sapiens
  Payload ID: 4254
  Gene Symbol: CCNI
  Gene Name: cyclin I
  ENST ID: ENST00000511943
  CDS Start-End: 266-436
gcggccgcagccgtgcgtcccgctcgagcgccagcgcccgcgcccgcgccccccgatccgcttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaattccagtactaaaggtattggcaagagacagtttctgtggatgttcctcatctgaaattttgagaatggagagaattattctggataagttgaattgggatcttcacacagccacaccattggattttcttcatattttccatgccattgcagtgtcaactaggcctcagttacttttcagtttgcccaaattga

SEQ ID NO: 123551 - DNA, 636 bp, Homo sapiens
  Payload ID: 4254
  Gene Symbol: CCNI
  Gene Name: cyclin I
  ENST ID: ENST00000515468
  CDS Start-End: 1-532
atctgaaattttgagaatggagagaattattctggataagttgaattgggatcttcacacagccacaccattggattttcttcatattatggatagctcccagttgatccattgtcgggagcttgtggcacatcacctttctactctgcagtcttccctgcctctgaattccgtttatgtctaccgtcccctcaagcacaccctggtgacctgtgacaaaggagtgttcagattacatccctcctctgtcccaggcccagacttctccaaggacaacagcaagccagaagtgccagtcagaggtacagcagccttttaccatcatctcccagctgccagtgggtgcaagcagacctctactaaacgcaaagtagaggaaatggaagtggatgacttctatgatggaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggc

SEQ ID NO: 123552 - DNA, 517 bp, Homo sapiens
  Payload ID: 4254
  Gene Symbol: CCNI
  Gene Name: cyclin I
  ENST ID: ENST00000513774
  CDS Start-End: 278-517
gcatcccccagcccggggaacctcggggccgccctcttcgtcctctccggcccagacagacccgtcacctgcccacttgaaaacggcactactgtgttccttttcgggccagtttttctgtcagcgagtaacttttttttgtggcagcggcaaattagctactctatagtgcgtgttggaggctctacgagcccgtgttaatacacaaagaaggggacacacccccaccctcaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgta

SEQ ID NO: 123553 - DNA, 541 bp, Homo sapiens
  Payload ID: 4254
  Gene Symbol: CCNI
  Gene Name: cyclin I
  ENST ID: ENST00000505609
  CDS Start-End: 165-541
aaataactggaatttgaaaggaggacagaggagcctccgctggagctagggggctccgttacagatccttttggcagaagttgacaattgggtatcaaaacagtggaaggtgtttcgggaggtagctacagcaagctgggtagcaggcagatccaaaggatatcatgaagtttccagggcctttggaaaaccagagattgtctttcctgttggaaaaggcaatcactagggaagcacagatgtggaaagtgaatgtgcggaaaatgccttcaaatcagaatgtttctccatcccagagagatgaagtaattcaatggctggccaaactcaagtaccaattcaacctttacccagaaacatttgctctggctagcagtcttttggataggtttttagctaccgtaaaggctcatccaaaatacttgagttgtattgcaatcagctgttttttcctagctgccaagactgttgaggaagatgagagaattccagtactaaaggtattggcaagagacagtttctgtggatgttcctcatctga

SEQ ID NO: 123554 - DNA, 2355 bp, Homo sapiens
  Payload ID: 4255
  Gene Symbol: CCNI2
  Gene Name: cyclin I family, member 2
  Uniprot ID: Q6ZMN8
  ENST ID: ENST00000378731
  CDS Start-End: 52-1161
tataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggagcggcctccctccacgcggcgtccgcagcagtccccgtgcggccccggcgcggtacggcgccagccgggaaaaccgcagacgcggtccccgccgccgccccagagcaagctccgcggccggctccacagtcccgcaagccgcgcaacctggaaggcgacctggacgagcgccggctgctctgccacttgcagctggcccaggaccgcgaggcgcgcctgtggcggggcggcaaaccccaggatgaaatctgcgacgccttcgaggaagtcgtgctgtggctcctgcggcttcagaacaccttttacttctcccagtccacttttaacctggccctcaccatctttggccgcctcctgatttcagtgaaggtaaaagagaaatacctgcattgcgccacaattacttccttgaggctcgctgcaaaagttaatgaagaagaggagtttattccacaagtaaaagacttcacaaagcactatggctctgactattccccgaatgagctgctgaggatggagctggctattctggacagactgcactgggacctctatattgggacgccgctggacttcttgactatattccatgccctggtggtcctgagctggccccatgtgttggagctgctgcctcagaggaatccttccctccacgtcgcatccctgaccaggcagctgcagcactgtatggcgggccaccagctgctgcagttcaagggctccacactggccttggtcatcatcaccttagagctggagaggctcatgcccggctggtgtgctcctatatctgatctgctaaagaaagcacaggttggtgatatgcagtacagctgctgcaaggaacttgtaatgcagcaactgagaagtcttcagtcatcctcctgcacagacaactttgtgtcacctgccaactagcccctctgcctccaccccggggctttcagagcatagtgtgaaacctccttgcttggactaccatgagttctttggcttgttatgaatcctgtaaaaagggaaggtggctctggaagagcaactgagaaaaagttcccaactgagcccttggaaaaaaaataaaggggagaggggaaaggcaggctgaggtcagtagaggtcagggtggtctgatagactatgaccctgtcttccctttttctcctctgggcctgaagccagggagtatgaatgaatgttcaaatggcagcttgttttaccttccttctccagcaagggttggcattggcccctgggagcgctggaatatgaaaccaagaggcaggcctggctcagggctgaagggctggggctagctctgaccagttcttgctgctctacctgccagagctggccaggtccttccaacttcccaggcttatcccaaacacatatgtggtgcttccagtcccaactaccctgcctgccactcctcacatgggacagtctctgcagatgcatttacccaaccatggctatgacttatgtcttccctttacaaggactggattataaagtatgctttgtttaatgtaacttgagcaagctttaggcatatctttcctttgttactcttaagcaaagtggtttcagttattagtttaactagagggattttgtgctaatgaatgggtattataggctaacacctgtgatgggaggcacagctctgaatgctttctgttgggatgagcaggttctgaggccaagcctgctccaaccacagtgctgccaggaggaggagccggctgcctctctcatgctgtgctaccacagagccattctctaagcaggggagtgcagctgacaaagatgccagctggggctgtgtaagttgtgttgggggcatgaatgactgagccacacattcagaggtggtttgtgaagtcttccactgtgaactatggttttttttttttttttttttttttggtgtgtttgtgtaaatgtgctaagccatggggtgggaggggaaagatttactaggtgcaaagtggtcaagggccagatatactataattgtctatattatagagttagtatacatctgtattttttcttgacacacttttgcttgttggtgctttcgttaaaattacactttaattgcttccg

SEQ ID NO: 123555 - DNA, 2642 bp, Homo sapiens
  Payload ID: 4255
  Gene Symbol: CCNI2
  Gene Name: cyclin I family, member 2
  Uniprot ID: Q6ZMN8
  ENST ID: ENST00000614847
  CDS Start-End: 52-1209
tataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctctgccccgaagcaaccggagcaggtgccctgggacccgccagcccggagcggcctccctccacgcggcgtccgcagcagtccccgtgcggccccggcgcggtacggcgccagccgggaaaaccgcagacgcggtccccgccgccgccccagagcaagctccgcggccggctccacagtcccgcaagccgcgcaacctggaaggcgacctggacgagcgccggctgctctgccacttgcagctggcccaggaccgcgaggcgcgcctgtggcggggcggcaaaccccaggatgaaatctgcgacgccttcgaggaagtcgtgctgtggctcctgcggcttcagaacaccttttacttctcccagtccacttttaacctggccctcaccatctttggccgcctcctgatttcagtgaaggtaaaagagaaatacctgcattgcgccacaattacttccttgaggctcgctgcaaaagttaatgaagaagaggagtttattccacaagtaaaagacttcacaaagcactatggctctgactattccccgaatgagctgctgaggatggagctggctattctggacagactgcactgggacctctatattgggacgccgctggacttcttgactatagaaaagtatggcgttttctgttctaacattaaaaaccatggtctccagttccatgccctggtggtcctgagctggccccatgtgttggagctgctgcctcagaggaatccttccctccacgtcgcatccctgaccaggcagctgcagcactgtatggcgggccaccagctgctgcagttcaagggctccacactggccttggtcatcatcaccttagagctggagaggctcatgcccggctggtgtgctcctatatctgatctgctaaagaaagcacaggttggtgatatgcagtacagctgctgcaaggaacttgtaatgcagcaactgagaagtcttcagtcatcctcctgcacagacaactttgtgtcacctgccaactagcccctctgcctccaccccggggctttcagagcatagtgtgaaacctccttgcttggactaccatgagttctttggcttgttatgaatcctgtaaaaagggaaggtggctctggaagagcaactgagaaaaagttcccaactgagcccttggaaaaaaaataaaggggagaggggaaaggcaggctgaggtcagtagaggtcagggtggtctgatagactatgaccctgtcttccctttttctcctctgggcctgaagccagggagtatgaatgaatgttcaaatggcagcttgttttaccttccttctccagcaagggttggcattggcccctgggagcgctggaatatgaaaccaagaggcaggcctggctcagggctgaagggctggggctagctctgaccagttcttgctgctctacctgccagagctggccaggtccttccaacttcccaggcttatcccaaacacatatgtggtgcttccagtcccaactaccctgcctgccactcctcacatgggacagtctctgcagatgcatttacccaaccatggctatgacttatgtcttccctttacaaggactggattataaagtatgctttgtttaatgtaacttgagcaagctttaggcatatctttcctttgttactcttaagcaaagtggtttcagttattagtttaactagagggattttgtgctaatgaatgggtattataggctaacacctgtgatgggaggcacagctctgaatgctttctgttgggatgagcaggttctgaggccaagcctgctccaaccacagtgctgccaggaggaggagccggctgcctctctcatgctgtgctaccacagagccattctctaagcaggggagtgcagctgacaaagatgccagctggggctgtgtaagttgtgttgggggcatgaatgactgagccacacattcagaggtggtttgtgaagtcttccactgtgaactatggttttttttttttttttttttttttggtgtgtttgtgtaaatgtgctaagccatggggtgggaggggaaagatttactaggtgcaaagtggtcaagggccagatatactataattgtctatattatagagttagtatacatctgtattttttcttgacacacttttgcttgttggtgctttcgttaaaattacactttaattgcttccgatcctgtatgagtcttattttgagctaccatgcatttagccttgcgagagtcagatacatttggaacactatctcctaggtcatatcaagaactctcctctagtccagaacccattttacagatggagatgctgaggccatgctgctcacagcttccagtggtggccgttgagtgccctctgcctccttccttccagtgtaagtgggaccacagtgcatgaggcagaaggacatcctga

SEQ ID NO: 123556 - DNA, 4115 bp, Homo sapiens
  Payload ID: 4256
  Gene Symbol: CCNJ
  Gene Name: cyclin J
  Uniprot ID: Q5T5M9
  ENST ID: ENST00000265992
  CDS Start-End: 368-1486
cgtgcgggatgctgaccgtacccaggcgggagccgccgcgccgccgcctggcgctgcacctgggcccggcccggccgccaattggacggctcggggcgaccccgctgtatcgcgagacgagattggcagcggcggggcctcaagtgcccccgcgctggctttgtatgcggagccgcctgccggtcctttaacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagtagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaattttcagtattttaactacctcaataatgctatgaatgtaagatattgggatagagatcccaacttgaaacaacagccagtgcctgtggtaacttaatgtcttgtcaaatacttttattgattggtttatatgccattcttgttatagaagaatatgccttttaaaaaagcttattaataacactttcccaatttatattttaaaaagctaaagaacactggattaataatcttttgggagggtagaataaaataattgattactattgctgcatacccggggtgggatggggtggttggagaaccagaactatttttaaaacattaggtttcaatataaatacaactcacaactgctagctttggggggtgggggaacattgtgtgggttttgttttgtttaatttattgattagtctttaaagtaggcttttttttttttttttgagaatactggaccatcattaaatgtgtactgtgaagagattaatatgtatgaagggctttaccaaagtccactaaataaacactactcaagtacagactgcaaaccaaaatgtatctgtgttacgacattaattgcaaatagcaagtatggtgctaaagtctacaccaatggaattagatgagtgctatgcacttaattttaaaataaaactagttttcagtaaaa

SEQ ID NO: 123557 - DNA, 2830 bp, Homo sapiens
  Payload ID: 4256
  Gene Symbol: CCNJ
  Gene Name: cyclin J
  Uniprot ID: Q5T5M9
  ENST ID: ENST00000403870
  CDS Start-End: 368-1483
cgtgcgggatgctgaccgtacccaggcgggagccgccgcgccgccgcctggcgctgcacctgggcccggcccggccgccaattggacggctcggggcgaccccgctgtatcgcgagacgagattggcagcggcggggcctcaagtgcccccgcgctggctttgtatgcggagccgcctgccggtcctttaacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttct

SEQ ID NO: 123558 - DNA, 2677 bp, Homo sapiens
  Payload ID: 4256
  Gene Symbol: CCNJ
  Gene Name: cyclin J
  Uniprot ID: Q5T5M9
  ENST ID: ENST00000465148
  CDS Start-End: 179-1330
aacaatgggcggcgcgagcgtccaggcgctgggctctagctgaggccggcgcttagcggcccactgtccgcagcatgagcggggccggcgtccgccgcacgacggcggggctggggctgtgagggccgcggttccggactcgagttgccgcgtcgggctgggcgcgccgccgggtcccatggagctggaggggcagtggtggcgaggacagctggccgccgatattcaccaagcgcttcgctacaaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaagattatgcctttctaaattatgcaccttctttagtagctgctgcatgtgtggcttcttcgaggattatacttcgtctttctccaacgtggcctacaagactacatcgtcttactgcctactcttgggatttcttagtgcagtgtattgaacgactgttgatcgctcatgataatgatgtgaaagaagcaaacaaacagagagggcaagcaggacctcagtcagcgcaactaagtgtattccagacagcctcccagccatcacggccagttcactttcagcaacctcagtatctccatcagacacatcagacctcactgcagtatcgccatcctacgtcagaacaaccaagctgtcagcagattgtatcgaccacacacacctcatcttacacactacagacatgtcctgctggcttccaaactagtgttcagggccttgggcacatgcagactggtgttgggatgtcactggcaataccagtagaagttaagccctgtctgagtgtttcttacaaccggagttatcagataaatgaacattacccttgtattactccatgttttgaaaggtgattatttgtgaagctgataaccgacccagactgctttgtgacatgaagctatgggtaagcgttttgtaaacttctgttcaaaaggaaagggatctaaatgacatcagaactcttcaggtaccagcaccaggaagactgaatatcctttttaatgcaccatgaatcctgggagactaagcaaattaacagtatgtcaaattctgttacaacaaatccctgtatgacaaaaatgttcaagtcctggctgatggtccaaatatttcaaaaatattcagtacaacagaaaatttggacagacttcaatttgccattttgagatttgacctgtggtagcatctgggcctaatgttggcttctaagtcaaagactaaatgtttatctcatctatggacttgccaaacagtcttttatgaaggaaagttacagtattaatttttgaaaaggttttttttattctgcaattttttatttttgttctacacatgaatttttgactaagtttaaactcatgaattgttatgctataccaatctgcagtaaaaaaaatttttttagatgattctatataacttcgtctcacaaatagtgtaggtatctgggtttatatactaaaattaagggtggagaagatcttattttttaaatcatggtcataatttttctttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttct

SEQ ID NO: 123559 - DNA, 1848 bp, Homo sapiens
  Payload ID: 4257
  Gene Symbol: CCNJL
  Gene Name: cyclin J-like
  ENST ID: ENST00000257536
  CDS Start-End: 287-1450
aattcccccagcgagggagggaggcccccggcggccgggagcctgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctg

SEQ ID NO: 123560 - DNA, 3320 bp, Homo sapiens
  Payload ID: 4257
  Gene Symbol: CCNJL
  Gene Name: cyclin J-like
  Uniprot ID: Q8IV13
  ENST ID: ENST00000393977
  CDS Start-End: 287-1594
aattcccccagcgagggagggaggcccccggcggccgggagcctgcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaaacggagtttcgctcttatcgcccaggctgaagtgcagtggcatgatctcagctcattgcaacctccacctcccaggttcaagcaattctcctgcttcagcgccccaccccccacccacaccgccccaagtagctgagactacaggtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctgaaaaaggaggggcagcctggcgtgttctcaggacccccggaggatcccatattgggtgcttttctttccctggctctatgcagaggggcctgagttggtgtgtatgcctgagtgtttgccttgcgaggcacagtgggtggctgtcttgcctttgttttcgaacctaaaaccattttcagccttttagatatgtcatgtgctgctgcttcccgaagtggtcttgctttctgtttcgtaagatgtcttgtttacacactgtatcagggatttggtgatacttgaaaattcctttggagaaaaaaacaaatttaattgccacactgcctgtcccacatgagggctgttaatttggaacccaagtttgaacccaacttgtgatggacccgcaggtaaccacagagcttcctttttgaaggcatatggttggagagaaccattttcccagctctcggttccggaagattccacgtcttggaggctgtgttcaccactagaactttaataactacccagggagggagaagctcgttgaaaggaagacaaagatttaaacagttcccacctctctccaccacatacttacagggcatgagtttaacccagtctaggctttgagtgtggctgatagcgaaggatagcaatgtggaaaatttgcttagtcccacctgtatttggggagtgggatgtacatgggcgtttgataccaccattgataggcaagcgactggttggatcaaaagccagtatttagggatctgcagcgagagggccctcaggaagactcttgtaaccatgtgcaatatgtttttattctgactcgcagcttgtgctcagcatgttctttggtttagtttggggttgggggacacattgttcacccagcagaactgggaggtgcaaaggaccgtggaagcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgctcttgatctctca

SEQ ID NO: 123561 - DNA, 940 bp, Homo sapiens
  Payload ID: 4257
  Gene Symbol: CCNJL
  Gene Name: cyclin J-like
  ENST ID: ENST00000519673
  CDS Start-End: 163-921
agtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtcccccttttcagatgaaaaatcctaggccccagcg

SEQ ID NO: 123562 - DNA, 914 bp, Homo sapiens
  Payload ID: 4257
  Gene Symbol: CCNJL
  Gene Name: cyclin J-like
  ENST ID: ENST00000520748
  CDS Start-End: 348-914
gcgagccgcggcgggacccgagcgcacgcaggggcgcggcgacggcgggggctagtcgggctgcggaggcggccgtcgggagtgcggagcgcctcggacgagggtccaaccgccggcaggcaccagagggcacggctggctcggcactgggaggggcccggcgctcgcagccccccacgcccagagaggatgcggtgcgccctgagagccgggtagcctcggatagcggcgctgcgtacgcgatgatggatgagccgtggtgggaagggcgcgtcgcctcggacgtccactgcaccctgcgcgagaaggtccttgatactttatgagcctgtgcttagtgaaagcagatgggagatagcccaggcggggctgccatcctgggacttgcaggaaaactaagaagggtatggagggaatcgttgcctcccattcaggccctgaggtcccatttcctgggacagccgagactctcaggaggcagccctgaccgtcacccctccgccccgcctgtcctccaggaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaagtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactac

SEQ ID NO: 123563 - DNA, 2965 bp, Homo sapiens
  Payload ID: 4257
  Gene Symbol: CCNJL
  Gene Name: cyclin J-like
  ENST ID: ENST00000541762
  CDS Start-End: 1-1251
agagaaaaagaactgaagctgcccaccttccgagcccactccccactcctgaagagccgccggttcttcgtggacatcctgaccctgctgagcagccactgccagctctgccctgcagcccggcacctggccgtctacctgctggaccacttcatggatcgctacaacgtcaccacctccaagcagctctacaccgtggccgtctcctgcctcctgcttgcaaacggagtttcgctcttatcgcccaggctgaagtgcagtggcatgatctcagctcattgcaacctccacctcccaggttcaagcaattctcctgcttcagcgccccaccccccacccacaccgccccaagtagctgagactacaggtaagttcgaggatcgggaagaccacgtccccaagttggagcaaataaacagcacgaggatcctgagcagccagaacttcaccctcaccaagaaggagctgctgagcacagagctgctgctcctggaggccttcagctggaacctctgcctgcccacgcctgcccacttcctggactactacctcttggcctccgtcagccagaaggaccaccactgccacacctggcccaccacctgcccccgcaagaccaaagagtgcctcaaggagtatgcccattacttcctagaggtcaccctgcaagatcacatattctacaaattccagccttctgtggtcgctgcggcctgtgttggggcctccaggatttgcctgcagctttctccctactggaccagagacctgcagaggatctcaagctattccctggagcacctcagcacgtgtattgaaatcctgctggtagtgtatgacaacgtcctcaaggatgccgtagccgtcaagagccaggccttggcaatggtgcccggcacaccccccacccccactcaagtgctgttccagccaccagcctacccggccctcggccagccagcgaccaccctggcacagttccagacccccgtgcaggacctatgcttggcctatcgggactccttgcaggcccaccgttcagggagcctgctctcggggagtacaggctcatccctccacaccccgtaccaaccgctgcagcccttggatatgtgtcccgtgcccgtccctgcatcccttagcatgcatatggccattgcagctgagcccaggcactgcctcgccaccacctatggaagcagctacttcagtgggagccacatgttccccaccggctgctttgacagataggccacctccagacctcacgaggaagccttggagatgtgggcagaggaagaggacactgaagaggagagctcagccaagtgaggcagcaggaggccatccctgaagagccttggaacgtggagggtctgtgctccttttaaataaaactgacccagagcaaaacattcaataacatacctcacccgagagcattcctctgagaaacgtctgccacgtgtggctagggtacaaaaggatggcttggtggccgtccccccacacaggggcccagtgaatcgagaaagacttgataagaggccaggagagtgggaactggacacagaccactgatctcaagcatgtccagtttttagcattaaagacttttctattctttgctgatggcagctacaccgctgaaaaaggaggggcagcctggcgtgttctcaggacccccggaggatcccatattgggtgcttttctttccctggctctatgcagaggggcctgagttggtgtgtatgcctgagtgtttgccttgcgaggcacagtgggtggctgtcttgcctttgttttcgaacctaaaaccattttcagccttttagatatgtcatgtgctgctgcttcccgaagtggtcttgctttctgtttcgtaagatgtcttgtttacacactgtatcagggatttggtgatacttgaaaattcctttggagaaaaaaacaaatttaattgccacactgcctgtcccacatgagggctgttaatttggaacccaagtttgaacccaacttgtgatggacccgcaggtaaccacagagcttcctttttgaaggcatatggttggagagaaccattttcccagctctcggttccggaagattccacgtcttggaggctgtgttcaccactagaactttaataactacccagggagggagaagctcgttgaaaggaagacaaagatttaaacagttcccacctctctccaccacatacttacagggcatgagtttaacccagtctaggctttgagtgtggctgatagcgaaggatagcaatgtggaaaatttgcttagtcccacctgtatttggggagtgggatgtacatgggcgtttgataccaccattgataggcaagcgactggttggatcaaaagccagtatttagggatctgcagcgagagggccctcaggaagactcttgtaaccatgtgcaatatgtttttattctgactcgcagcttgtgctcagcatgttctttggtttagtttggggttgggggacacattgttcacccagcagaactgggaggtgcaaaggaccgtggaagcaatttttgttttgtttgaggaatacctgtcttggattccttagccccttgccagtcctggagactgtggcaggggccgccaggaaggcagctgtctgctgctgagtcagatcggaaggtggtgaatctttccagagcagctgaaaatctcagcatggagacagtaagaaaagagacggggtgtggataagactctgccaccgtgtcacactagcataggaggctgcacgttcatttgttgttgtttttttttcctttgccaacctccgttctatttatgtgcaagcagtttggattcaagttcttgtatctgtctgttctgggacctggggattgtgagggttccctcacagccagcacgacccccagaaagaggcgtcccacaataaacacgtcacctgct

SEQ ID NO: 123564 - DNA, 3524 bp, Homo sapiens
  Payload ID: 4258
  Gene Symbol: CCNK
  Gene Name: cyclin K
  Uniprot ID: O75909
  ENST ID: ENST00000389879
  CDS Start-End: 124-1866
gacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcagaaccaccaccacctaaaatccccaaaattgagaccactcatccaccgttgcctccagcccacccacctccagaccggaagcctcccctcgctgctgccttaggtgaggctgagccgccgggccctgtggatgccactgacctccccaaagtccagattccccctccggcccacccggcccctgtgcaccagccaccgccgctgccacaccggcccccgcccccacccccctccagctacatgaccgggatgtccaccaccagctcctacatgtctggagagggctaccagagcctgcagtccatgatgaagaccgagggaccctcctacggtgccctgccccccgcctacggcccacctgcacacctgccctaccacccccatgtctacccgcccaacccgcccccgccacctgtgcctcctcccccagcctccttccccccacctgccatcccaccccctactcctggctaccccccacccccacccacctacaaccccaacttcccacccccacccccacgcctcccgcctacccacgcagtcccccctcatcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaa

SEQ ID NO: 123565 - DNA, 811 bp, Homo sapiens
  Payload ID: 4258
  Gene Symbol: CCNK
  Gene Name: cyclin K
  ENST ID: ENST00000555842
  CDS Start-End: 483-811
gatggccgcagtcggcaaggagagacgtcgctgaggggcttgcctgaagcgagggcatggagcttttggagagtgtctttattctgagtgaaagaaaaggaagaggatgaaaaagcaagaacagtttaaaggagctccttctctcatggaccacttccatccacccactccccaaatcacaagatgcacatttggtttacatcagtgaattcagtgatttgtgcagatgtgaattaacccaatcccatgacttgtctaagtgaaagtgcctacatggaataaactgaaaaggggtgctggatggaagagatggttagttttagaacataaatctttgtcaagattaagacaggcccaggttttgctgaagaatggaatctggaccagcgttagaggacctgtatgtctagtgaagaaaaaccagaagaaagattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacacc

SEQ ID NO: 123566 - DNA, 936 bp, Homo sapiens
  Payload ID: 4258
  Gene Symbol: CCNK
  Gene Name: cyclin K
  ENST ID: ENST00000557441
  CDS Start-End: 256-936
attccatatacaagatggccgcagtcggcaaggagagacgtcgctgaggggcttgcctgaagcgaggggtgagtgacccaccgactgagggcagcgccgcccacctcccgcgtatctggaggtcggagtaggttatggccaaccgccgctatccactggcggagtctctctttccggattctgcctccctccgctaacctccggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctcc

SEQ ID NO: 123567 - DNA, 1606 bp, Homo sapiens
  Payload ID: 4258
  Gene Symbol: CCNK
  Gene Name: cyclin K
  ENST ID: ENST00000555049
  CDS Start-End: 109-1245
agatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcagaaccaccaccacctaaaatccccaaaattgagaccactcatccaccgttgcctccagcccacccacctccagcttccacacaccctccttagcaaccacaatggccccgccaggtctgcaatggaaggctggcgtctagggagccccactccacagacaggtgagaccccagcccctcctgccctcaccagccctgggaagccagcacggcctgtggccaaagcccttcaccatagggcacctgacagcaaggcatgaaattacaaaagccagccttgccattcagagcttggctgtgcacttgcgcctgtatggtggtggggagtggggggcggggtgtggaggagagttcacaagaggccaaatgaggaacgtgcactctgctaatcccaccaggccctgggaaccttccccacagcccacaaaggggtgagacgtgaggatgacctcagt

SEQ ID NO: 123568 - DNA, 549 bp, Homo sapiens
  Payload ID: 4259
  Gene Symbol: CCNL1
  Gene Name: cyclin L1
  Uniprot ID: Q9UK58
  ENST ID: ENST00000295925
  CDS Start-End: 1-519
atggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtc

SEQ ID NO: 123569 - DNA, 2388 bp, Homo sapiens
  Payload ID: 4259
  Gene Symbol: CCNL1
  Gene Name: cyclin L1
  Uniprot ID: Q9UK58
  ENST ID: ENST00000295926
  CDS Start-End: 120-1700
acgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaaa

SEQ ID NO: 123570 - DNA, 793 bp, Homo sapiens
  Payload ID: 4259
  Gene Symbol: CCNL1
  Gene Name: cyclin L1
  ENST ID: ENST00000468977
  CDS Start-End: 1-178
cagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatgtaagatgtatttagaattaaaatgacttgggggcactgaaagtgtgtctttattagagagcttttacatttgaaagttgcatagagaaaaatgatgttaggaaactgctgctatgttctctcatggcagtcaaccaacatggaagcggaagcatgcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatct

SEQ ID NO: 123571 - DNA, 1889 bp, Homo sapiens
  Payload ID: 4259
  Gene Symbol: CCNL1
  Gene Name: cyclin L1
  Uniprot ID: Q9UK58
  ENST ID: ENST00000470121
  CDS Start-End: 1-699
atggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaatgtgtatagcatgaatactaccaaaggagacgacaaacttgcagcttaaaatgggcaccagttcccacactggcttaatttatataactgcttggctgtattgcgggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctga

SEQ ID NO: 123572 - DNA, 2362 bp, Homo sapiens
  Payload ID: 4259
  Gene Symbol: CCNL1
  Gene Name: cyclin L1
  Uniprot ID: Q9UK58
  ENST ID: ENST00000475298
  CDS Start-End: 62-580
cgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacagactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaa

SEQ ID NO: 123573 - DNA, 793 bp, Homo sapiens
  Payload ID: 4259
  Gene Symbol: CCNL1
  Gene Name: cyclin L1
  Uniprot ID: Q9UK58
  ENST ID: ENST00000465947
  CDS Start-End: 43-561
gggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacagtgagactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctg

SEQ ID NO: 123574 - DNA, 1464 bp, Homo sapiens
  Payload ID: 4259
  Gene Symbol: CCNL1
  Gene Name: cyclin L1
  Uniprot ID: Q9UK58
  ENST ID: ENST00000477127
  CDS Start-End: 85-603
gggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacagtgagtgaagtatcgaaaatccccaaggagaagccagtgctctgagaataggtcactggaatcggggactaacaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagaca

SEQ ID NO: 123575 - DNA, 1998 bp, Homo sapiens
  Payload ID: 4259
  Gene Symbol: CCNL1
  Gene Name: cyclin L1
  ENST ID: ENST00000461804
  CDS Start-End: 667-1953
atgcctccgccctacttccccatactggcaaaaacacgctccccggggagctttcatttgggaaccgatagggtccacagccctgtgttcttcaaatactgtaaagcagccctctccagattccttgagggtcactttatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacaagacgaggtcttgctacgttgcccaggtcggtcacgaactcctggcctcaagtgatcctcccacctcagcctcccaagtattaaattcttaatagtgttg

SEQ ID NO: 123576 - DNA, 2457 bp, Homo sapiens
  Payload ID: 4259
  Gene Symbol: CCNL1
  Gene Name: cyclin L1
  Uniprot ID: Q9UK58
  ENST ID: ENST00000631619
  CDS Start-End: 270-788
gagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtgatgtggagtggtacatagagatgaagctgtcgtcatggcaacagtgagtgaagtatcgaaaatccccaaggagaagccagtgctctgagaataggtcactggaatcggggactaacaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctgggtagtccatgatggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaa

SEQ ID NO: 123577 - DNA, 2305 bp, Homo sapiens
  Payload ID: 4260
  Gene Symbol: CCNL2
  Gene Name: cyclin L2
  Uniprot ID: Q96S94
  ENST ID: ENST00000400809
  CDS Start-End: 7-1569
cacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcagga

SEQ ID NO: 123578 - DNA, 1857 bp, Homo sapiens
  Payload ID: 4260
  Gene Symbol: CCNL2
  Gene Name: cyclin L2
  ENST ID: ENST00000408952
  CDS Start-End: 86-1129
attttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagagggcccaagcccggggcctgttgcctgggggcacacaggtgctggatggtacctcggggttctctcctgcccccaagctgggtgctgggattacagcctggagtgcagtggcgctatctgggatcactgcaagctccgcctaccagattctggtgattcttgtgcctcagcctcccaagtagctgggattgcaggcgcccaccaccacgctcagagtctcgctgtgttgccagtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctcc

SEQ ID NO: 123579 - DNA, 1186 bp, Homo sapiens
  Payload ID: 4260
  Gene Symbol: CCNL2
  Gene Name: cyclin L2
  Uniprot ID: Q96S94
  ENST ID: ENST00000408918
  CDS Start-End: 12-692
ggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgt

SEQ ID NO: 123580 - DNA, 661 bp, Homo sapiens
  Payload ID: 4260
  Gene Symbol: CCNL2
  Gene Name: cyclin L2
  ENST ID: ENST00000425598
  CDS Start-End: 20-562
ggggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtgagggcgcggccgcgagcctccggcccaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtacct

SEQ ID NO: 123581 - DNA, 2815 bp, Homo sapiens
  Payload ID: 4260
  Gene Symbol: CCNL2
  Gene Name: cyclin L2
  ENST ID: ENST00000481223
  CDS Start-End: 6-716
acaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgaggaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagctttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagtt

SEQ ID NO: 123582 - DNA, 1598 bp, Homo sapiens
  Payload ID: 4260
  Gene Symbol: CCNL2
  Gene Name: cyclin L2
  ENST ID: ENST00000488340
  CDS Start-End: 23-706
gaaggggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtg

SEQ ID NO: 123583 - DNA, 2059 bp, Homo sapiens
  Payload ID: 4260
  Gene Symbol: CCNL2
  Gene Name: cyclin L2
  ENST ID: ENST00000482621
  CDS Start-End: 1-139
agaagaggccccaagacgcatacgggacgtcatcaatgtgtttcaccgccttcgacagctgagagacaaaaaaccctgtgctctctctctggcaggaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgtt

SEQ ID NO: 123584 - DNA, 548 bp, Homo sapiens
  Payload ID: 4260
  Gene Symbol: CCNL2
  Gene Name: cyclin L2
  ENST ID: ENST00000497013
  CDS Start-End: 292-548
gcggcgagtcgggcccgcaccgcccccgcctagaccccgaccccagcccctgccccgaccccagcctcggcgccattccctagccagcccatgcccctgacccggggcctccccgcccgccagtgcgctggatcccgagacggcgggacgcgaagagcctttgtggacgtgggaagcgtttcagtgtttggttctgcgtggggagtcccacgttactcgatgactttcggccgcgaaggctttgaatggtgcgtttgaaaatacggaaactttcttctactctaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttct

SEQ ID NO: 123585 - DNA, 2369 bp, Homo sapiens
  Payload ID: 4261
  Gene Symbol: CNTD1
  Gene Name: cyclin N-terminal domain containing 1
  Uniprot ID: Q8N815
  ENST ID: ENST00000588408
  CDS Start-End: 277-1269
agagccgcggttcccgggcacaggggatggacgcgggaggtgagaagcggacgtgctttctgattggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtggagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgcactcatgcctccctctgtttactttcatactaagggtacaaaaattccaagtctcttttgaactgtattttgtatgccaatttcatgcttatttttcctttatcagagagagttaaggtggacgagcatgccctttttgtcatatcagcctgaaaatgttaaaaagctaggtggagacagattagttgtttcatttttgtttaacaaggtatttatacttttagcttaatttcattaagaggaacatcaggcattgcaatcagtattaatcaggggctcaaatacagactatctgggtgaccttgactaagcatcaaggaggtagcctttatttccccttaaaattagtttaacatctctgttccattattcagatctacacaaacaaggcttcctcaacagctatctatttttactagagtctttttttaaaactaaaactaactctaaagaagtttcaacagaatttccacatacctgcattcattagaacttgattctcccagaatacaaagtactctattttaaagaaaaacccaacagtgcacccctgggcagttttcagactgcagcaaatcttttattacaaataattaaatctctccataatgtctcaaacagtatcaaacaccatttcatatctctaacacagagcagagtcggcattcagtataagaaccaagtgaaaagtgttaaatttcaagcatctgatcacatcacatggtgaccaggtaaagcttagatgtcattttcccacattatccaactgtgcatctcaaacatatcctcatctcagtaaagacaaaagtttctatttcatattgttaagtgcaggaagttgagagagataaaaatccagtgaaaacacatcaatctcaattcaactcagttaaaaaaaagaaaagcaaatttaaattagtttttttcagagaagaaagggaaaggagtccatggggttaagaatcaaaactgaccagggctggcaactatagatggcatgttgtagctctggaaagtatctgtcacatgatattttaaaataaagtggcttttgtgg

SEQ ID NO: 123586 - DNA, 547 bp, Homo sapiens
  Payload ID: 4261
  Gene Symbol: CNTD1
  Gene Name: cyclin N-terminal domain containing 1
  ENST ID: ENST00000585355
  CDS Start-End: 19-547
ggttcccgggcacaggggatggacgcgggagagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttga

SEQ ID NO: 123587 - DNA, 504 bp, Homo sapiens
  Payload ID: 4261
  Gene Symbol: CNTD1
  Gene Name: cyclin N-terminal domain containing 1
  ENST ID: ENST00000586652
  CDS Start-End: 1-342
acgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggtatgcaccactgagcaggaccagcatggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgca

SEQ ID NO: 123588 - DNA, 904 bp, Homo sapiens
  Payload ID: 4261
  Gene Symbol: CNTD1
  Gene Name: cyclin N-terminal domain containing 1
  ENST ID: ENST00000592166
  CDS Start-End: 215-394
attggctgaggagtccgtggccgttggggcgggaaaaagctgtggagggttcgaggctgtggtggtaattgggttttcctcagacttgaggcgacgacacactcattggaaggggacgaggaatccagggtgtggcagaagactggagaggagctaagggggtcggtatgtggatccagtgaacccgtccaggtgccccaagaggctcgtgaatatggacggacccatgaggccacgatcggcctccctcgttgactttcagtttggagttgtcgccacagagacgattgaagacgccctgcttcacttggcccagcagaatgagcaagcagtgagggaggcttcggggcggctgggccgcttcagggagccccagatcgtgggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttgg

SEQ ID NO: 123589 - DNA, 1308 bp, Homo sapiens
  Payload ID: 4261
  Gene Symbol: CNTD1
  Gene Name: cyclin N-terminal domain containing 1
  ENST ID: ENST00000588527
  CDS Start-End: 213-956
aaaaagctgtggagggttcgaggctgtggtggtaattgggttttcctcagacttgaggcgacgacacactcattggaaggggacgaggaatccagggtgtggcagaagactggagaggagctaagggggtcgagtttgtttttctcctgtctgaacaatggtgtctggagaaatctgtgagctaccaggctgtagaaatcctagaaaggtttatggtaaaacaggcagagaacatctgcaggcaagccacaatccagccaagagataataagagagagtctcagaattggagggctctgaaacagcagcttgtcaacaagtttactctccgtcttgtgtcatgtgttcagctggccagcaaactttccttccgaaacaaaataatcagcaacattacagtcttgaatttcctccaggctctaggctatctacacactaaagaagaactgctggaatcagagcttgatgttttgaagtccttgaacttccgaattaatctgcccactcccctggcatatgtggagacgctcctagaggttttaggatacaatggctgtttggttccagccatgaggctgcatgcaacctgcctgacactgctcgacctggtctatcttctgcatgaacccatatatgagagcctgttgagggcttcaattgagaactccactcccagtcagctgcaaggggaaaagtttacttcagtgaaggaagacttcatgctgttggcagtaggaatcattgcagcaagtgctttcatccaaaaccatgagtgttggagccaggttgtggggcatttgcagagcatcactggtattgccttggcaagcattgctgagttctcttatgcaatcctgactcacggagtgggagccaacactccggggagacagcagtctattcctccccacctggcagccagagctctgaagactgttgcttcctctaacacatgagggaggctgaatccaccaaatataaacagccatccgtcactgcactcatgcctccctctgtttactttcatactaagggtacaaaaattccaagtctcttttgaactgtattttgtatgccaatttcatgcttatttttcctttatcagagagagttaaggtggacgagcatgccctttttgtcatatcagcctgaaaatgttaaaaagctaggtggagacagattagttgtttcatttttgtttaacaaggtatttatacttttagcttaatttcattaagaggaacatcaggcattgcaatcagtattaatcaggggctcaaatacagactatctgggtgaccttgacta

SEQ ID NO: 123590 - DNA, 1783 bp, Homo sapiens
  Payload ID: 4262
  Gene Symbol: CNTD2
  Gene Name: cyclin N-terminal domain containing 2
  Uniprot ID: Q9H8S5
  ENST ID: ENST00000221818
  CDS Start-End: 17-484
aacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgaggaaactgaggtccggaacttggggcctttccagggcagggagtaaagagcccggatccaagactccttcacctccccccgcatcccccatctgcagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggaccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccacttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttatttt

SEQ ID NO: 123591 - DNA, 1817 bp, Homo sapiens
  Payload ID: 4262
  Gene Symbol: CNTD2
  Gene Name: cyclin N-terminal domain containing 2
  Uniprot ID: Q9H8S5
  ENST ID: ENST00000430325
  CDS Start-End: 50-973
tagctgcaagggtcggtgcttggcctcgcccgcaacaccctcctggaggatgctggtgagaggcagggaccaggggtccggctcccggctcgggcctatcgttaggcgctgggcccccaggccctctcctttgcagagtctcgctgcctccctcgacgcagagccttcaagcgccgcagtccccgacggcttccccgcgggccccactgtctccccaagacgcctggcgaggccgccggggctggaggaggcgctgagcgcgctggggctgcagggagaacgcgagtacgccggggacatcttcgccgaagtcatggtgtgccgcgtgctgcccctgagagccctgccccgcgctgtgaccccggagatgcgcgccctggtggtagactggctggtccaggtgcacgagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggaggaggtggcacctagacttgatttttctgggtgtgggagagaatggggtgggaggaccccattagtccagatctggggtctcttaaccttgccccagagtggaagatagtctcccaggcccagaagatgctcctattgccttccagggctgagaacgaaggatcacccaggcctcgagtcctccatctctgtatctggtggtggatggggtgttcctttagctgctagggccgctaaccatgctaccaggtggcagggcgaaccatggtttccctcagcctgtgcacccagcatagagaggatggctgcccatcctcagctcccctccttgcttcctcgagtgttctgactccgcactagccgcgccctgtaggaagaatagggtgtccacctctccccggtgctcgcctagtcactccagttgaagacgggacgcgtgcccgatctcaagagagcccccgacccgtccgtggggaaccacatcgacgcttcttctcagcctccagtctccagttccaaggatgggtcatctccaaccacttgccctgcctcagtttctccatctccctgctgcagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctga

SEQ ID NO: 123592 - DNA, 787 bp, Homo sapiens
  Payload ID: 4262
  Gene Symbol: CNTD2
  Gene Name: cyclin N-terminal domain containing 2
  ENST ID: ENST00000513948
  CDS Start-End: 178-783
cagtttgggtgtggcatgcctaagatgtccaactgactggaggaggctgctgcatccagggctggagctcaggagaaaggcagaggcacaggtgtggagagtgaagcgtccctgccccaaccccaggtgtgccgcgtgctgcccctgagagccctgccccgcgctgtgaccccggagatgcgcgccctggtggtagactggctggtccaggtgcacgagtacctgggtctggctggtgacacactttatctggcggttcacctgcttgattcctacctgagcgctggccgcgtgcgtctacatcgcctgcagctgctgggcgtggcttgcctgtttgtggcgtgcaaaatggaagagtgcgtgcttcccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacaggtgtagtcttggcggaggaagtgtatggggtcaccgcagcttcagggacttaccttcctggtcatttttacggtctcggagaatgagagacaattattgaggag

SEQ ID NO: 123593 - DNA, 582 bp, Homo sapiens
  Payload ID: 4262
  Gene Symbol: CNTD2
  Gene Name: cyclin N-terminal domain containing 2
  ENST ID: ENST00000599263
  CDS Start-End: 1-483
cccgagcccgccttcctctgcctcctgagcgcggactccttctcacgggcggagctgctgcgcgccgagcgtcgcatcctgagccgcctggatttccggctgcaccaccccggcccgctgctgtgcctcgggctgctggccgcgctggcagggagcagcccccaggtgatgttacttgccacctacttcctggagctgtctttgctggaggccgaggcggcgggatgggagccgggtcgtcgtgcggctgcggctctgagcctggcgcaccgcttgctcgacggggcgggctccaggctccagccagaactttacagccccgaggaactgggcaccctcgagccgtgcatggcccgcgctgcgctccgaggtcccgcgccgggtcgcgccgcagtcttcctcaagtatgcgcggccccagcgccaggggaccagccttgccgccgcctgcctgctccgccgcctccagtctgagcctccctgagtactgggactcagtcacaaaaaaatcaacaacaaaaaacaaaaccctcccagtgtgtgtccgtctctcatctcaataaaagaatttattttattctga

SEQ ID NO: 123594 - DNA, 1433 bp, Homo sapiens
  Payload ID: 4263
  Gene Symbol: CCNO
  Gene Name: cyclin O
  Uniprot ID: P22674
  ENST ID: ENST00000282572
  CDS Start-End: 158-1210
agtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaa

SEQ ID NO: 123595 - DNA, 1726 bp, Homo sapiens
  Payload ID: 4263
  Gene Symbol: CCNO
  Gene Name: cyclin O
  Uniprot ID: P22674
  ENST ID: ENST00000501463
  CDS Start-End: 75-470
cactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttcatctgcaaaatggaacccctccccttcctttgaattgctgagcccattacgcgaggtgacggcggaatcccgctgtaagctgctcagctggctgatcccggtgcaccgccaattcggcctctccttcgagtcgctgtgcctgacggtgaacactctggaccgcttcctcaccaccacgccggtggctgcagactgcttccagctgcttggggtcacctccttgctcatcgcttgcaaacaggtggaggtgcacccgccgcgcgtgaagcagcttctggccctctgctgcggcgccttctcccggcagcagctctgcaacctcgagtgcatcgtgctgcacaagctgcacttcaccctgggtgcgcccaccattagcttcttcctggagcatttcacgcacgctcgcgtggaggcggggcaggctgaggcctccgaagctctggaagcgcaagccctggcgcggggggtggcagagctgagtctggccgactatgccttcaccagctactccccttccctcctggcgatctgctgcctggcgctggcggaccgcatgctgcgggtctcgcggcccgtggacttgcgactgggagaccacccggaggcggcgctggaggactgtatgggcaagttgcagctgctggtggccataaacagtacttccttgactcacatgctgcccgttcagatctgcgagaagtgcagcctgcccccgagctcgaaataaaacagatccttcgtttccttttagtccctggcccggctgctggacctctcccgtagcctcagaagagtgcagtactggtccacagagaaggcttcaggacctgcttggtcagctgcaggttgtaaatagtgtacgatactagcatctggtattttatttattttgcagcgagcacatgaggaagctgagtctttcaccaataaacagttgtggtttgtctaaa

SEQ ID NO: 123596 - DNA, 2060 bp, Homo sapiens
  Payload ID: 4264
  Gene Symbol: CNPPD1
  Gene Name: cyclin Pas1/PHO80 domain containing 1
  Uniprot ID: Q9BV87
  ENST ID: ENST00000360507
  CDS Start-End: 139-1371
gcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgctcctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 123597 - DNA, 2073 bp, Homo sapiens
  Payload ID: 4264
  Gene Symbol: CNPPD1
  Gene Name: cyclin Pas1/PHO80 domain containing 1
  Uniprot ID: Q9BV87
  ENST ID: ENST00000409789
  CDS Start-End: 429-1661
tgacgaagtaccccgggttccgagtccgggtctaggtccaggcagtcgagcccgttttcttatcccacagtaggcagggcggctagggagtgtggtgctgccccggtatccccgtgtggggcaggaagtgggcttccagattcccagtatccccggtagggtctgcttctgctcgctcgggaagggcggtggccgtcccattactcaaccaaccctcaacgcactggtcctcccagttccctcccctcagtgggtaaacaaacacacaccagcgcttgactcgacagactcgaaaacaacatctactcagaaaagttgtttctttcctatctccttaaactttcccacttccacatatcggagcttcttcccacctcggcctactcaagcatgagatcggaggcgggagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgctcctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagc

SEQ ID NO: 123598 - DNA, 919 bp, Homo sapiens
  Payload ID: 4264
  Gene Symbol: CNPPD1
  Gene Name: cyclin Pas1/PHO80 domain containing 1
  ENST ID: ENST00000451647
  CDS Start-End: 71-919
gacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatggtaagacaccccctccccatctccctaaagagccaagagcctgctatgagctctgctccaccacttctggttcctctgcagatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtct

SEQ ID NO: 123599 - DNA, 1154 bp, Homo sapiens
  Payload ID: 4264
  Gene Symbol: CNPPD1
  Gene Name: cyclin Pas1/PHO80 domain containing 1
  ENST ID: ENST00000453038
  CDS Start-End: 230-1154
aggcgcctggggcttggccacgttccgtgagaccaggagttcgagtccggttcctgcccgcgggtcggggcgggaggctgggccagatgggcggcaggaagtgccaggcgctgacttgcaggcggcacccccgcggcttgtaaacgccgggcggacgcggcacaggcggagtacgcgcctcgcagccgcatctcctttctgctccgcgagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatatgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactct

SEQ ID NO: 123600 - DNA, 6973 bp, Homo sapiens
  Payload ID: 4265
  Gene Symbol: CCNT1
  Gene Name: cyclin T1
  Uniprot ID: O60563
  ENST ID: ENST00000261900
  CDS Start-End: 224-2404
gcatattggctgttaactcggctacggggtgtagcgaggtgcattccggaagtaggtcctttgacttttgcttcctctacggaggcaagtaacaacccggcggtcgacgcttagcggaagttcgtcaagtcgcagttgcccccgcacagcggatgtgggtcgcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagcctgcatttgaccacatttagcctgcagtacacacctcctgtggtggcctgtgtctgcattcacctggcttgcaagtggtccaattgggagatcccagtctcaactgacgggaagcactggtgggagtatgttgacgccactgtgaccttggaacttttagatgaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattcttggcctctccaccatctaattaggttgattggagttgatatcttccctcttcttgccagagctgaaaaatggagggtttcttgtatcagacaattgtggatcctttcggtgtttaatatatcagaagagaggaagtatttaaacgtcaaatcttttaatagacttaataatttaaagaaagtaagttatctgtttagtttttttatataattgggaaggggatagggattttgctgtgtgtatatgatacatagcagtaactcctggtgggtgggattggagggtgggaatgtgtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaacataaaggaagaggcatgtatttgacatggtatttttccctttctttatgttataattgagtagtagccctctaatttgtagtttgggcaagtacagccaacaccctgactcttaaccttattatgagaacttcctttttacccctttttttgtttttgtgcaaaacagagatggggttgaggaaggagggttggcgagcaaggccagcttctgccctacagaattgggtgtgtcttttttttcaagtgaggctttgggaaagtgttcaaatgagagcagtcttaaggtctctaagagatggggaatgtgctatgtatatcctgcctgtgaaagcccaaaccatatgggagaagctagaggatactaaaaacaatgaaattgtgatttggaagtttagaacattgttttaaaaattacattataaatgtaagacatgctttttatgtgtatatccgaagggaaacagctacatcctcaagtttttgcagcctatatgacttgagattggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaa

SEQ ID NO: 123601 - DNA, 2017 bp, Homo sapiens
  Payload ID: 4265
  Gene Symbol: CCNT1
  Gene Name: cyclin T1
  Uniprot ID: O60563
  ENST ID: ENST00000417344
  CDS Start-End: 1-555
atggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaa

SEQ ID NO: 123602 - DNA, 6915 bp, Homo sapiens
  Payload ID: 4265
  Gene Symbol: CCNT1
  Gene Name: cyclin T1
  Uniprot ID: O60563
  ENST ID: ENST00000618666
  CDS Start-End: 324-878
gggaagatacacggtttttaagaaagaacttctaaccccactccaccgcccaacggtcacgtgacgcgcctgcgtcctcgcctcaaggttttttctggtcgcatattggctgttaactcggctacggggtgtagcgaggtgcattccggaagtaggtcctttgacttttgcttcctctacggaggcaagtaacaacccggcggtcgacgcttagcggaagttcgtcaagtcgcagttgcccccgcacagcggatgtgggtcgcctcttaggtgacgctgggaagtgcctgcagccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattcttggcctctccaccatctaattaggttgattggagttgatatcttccctcttcttgccagagctgaaaaatggagggtttcttgtatcagacaattgtggatcctttcggtgtttaatatatcagaagagaggaagtatttaaacgtcaaatcttttaatagacttaataatttaaagaaagtaagttatctgtttagtttttttatataattgggaaggggatagggattttgctgtgtgtatatgatacatagcagtaactcctggtgggtgggattggagggtgggaatgtgtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaacataaaggaagaggcatgtatttgacatggtatttttccctttctttatgttataattgagtagtagccctctaatttgtagtttgggcaagtacagccaacaccctgactcttaaccttattatgagaacttcctttttacccctttttttgtttttgtgcaaaacagagatggggttgaggaaggagggttggcgagcaaggccagcttctgccctacagaattgggtgtgtcttttttttcaagtgaggctttgggaaagtgttcaaatgagagcagtcttaaggtctctaagagatggggaatgtgctatgtatatcctgcctgtgaaagcccaaaccatatgggagaagctagaggatactaaaaacaatgaaattgtgatttggaagtttagaacattgttttaaaaattacattataaatgtaagacatgctttttatgtgtatatccgaagggaaacagctacatcctcaagtttttgcagcctatatgacttgagattggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaacactca

SEQ ID NO: 123603 - DNA, 6917 bp, Homo sapiens
  Payload ID: 4266
  Gene Symbol: CCNT2
  Gene Name: cyclin T2
  Uniprot ID: O60583
  ENST ID: ENST00000264157
  CDS Start-End: 31-2223
aatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctataaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtattttcagaaccaaagcaaagggtggtttgttcactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgagtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagacagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaa

SEQ ID NO: 123604 - DNA, 4491 bp, Homo sapiens
  Payload ID: 4266
  Gene Symbol: CCNT2
  Gene Name: cyclin T2
  Uniprot ID: O60583
  ENST ID: ENST00000295238
  CDS Start-End: 31-2022
aatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcattttta

SEQ ID NO: 123605 - DNA, 638 bp, Homo sapiens
  Payload ID: 4266
  Gene Symbol: CCNT2
  Gene Name: cyclin T2
  ENST ID: ENST00000452521
  CDS Start-End: 1-448
caacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgat

SEQ ID NO: 123606 - DNA, 663 bp, Homo sapiens
  Payload ID: 4266
  Gene Symbol: CCNT2
  Gene Name: cyclin T2
  ENST ID: ENST00000446247
  CDS Start-End: 271-663
tgttggtggcggaggccggagtcgcacgcctacgagactgcgcggacccgcccaaaaggaaaatggaagtagtggcgtgaggctgcgacagtgaagataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagat

SEQ ID NO: 123607 - DNA, 2363 bp, Homo sapiens
  Payload ID: 4266
  Gene Symbol: CCNT2
  Gene Name: cyclin T2
  ENST ID: ENST00000452839
  CDS Start-End: 34-555
gtgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagatctttgggggatagcaagaaacatttgagtgaatgttgttgaagattttcagtagtatagaaaatgatggcgctcttgtgatatttcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaaga

SEQ ID NO: 123608 - DNA, 811 bp, Homo sapiens
  Payload ID: 4266
  Gene Symbol: CCNT2
  Gene Name: cyclin T2
  ENST ID: ENST00000417175
  CDS Start-End: 9-530
gaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtacaagcaaggatttggcacagacatcctatttcatggctaccaacaggttgttatcctgaccctctttgttgcactgttgtagcacactatagcttcctttaatgcagggccccc

SEQ ID NO: 123609 - DNA, 5414 bp, Homo sapiens
  Payload ID: 4266
  Gene Symbol: CCNT2
  Gene Name: cyclin T2
  ENST ID: ENST00000419781
  CDS Start-End: 621-1142
ggagactgttggtggcggaggccggagtcgcacgcctacgagactgcgcggacccgcccaaaaggaaaatggaagtagtggcgtgaggctgcgacagtgaaggttatttttctctttttaaagggccgctagacctcccgtctaaaggaagcgcccgacgggcctccgaagtacacgcccaggcccccacagcgcagccgcccgaccgcctctcttcacaccggccagagtccaccctctcccactttcccctcccctcccctccccgccccttccctccccaccccttcgccccgccaaccctagacccggcatgcgctgcgccgaccttttccttccgagccgacctctccaccttcggcgcctcccaatgacaagcggcgcggagcattgtggtcccgtgcgcaagagcgaggccgagggcagaaaaagaaagcaaaagactagggcgagtcggtagagcgggccccgcgcatgcgcaagggcggaggcggtggtgaaaaagggtggtgcgtggtctacggcgagcggagtggggcggggtcgcgcgccttggcggggagtccgcgagccaggaggggcggggggtgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagatctttgggggatagcaagaaacatttgagtgaatgttgttgaagattttcagtagtatagaaaatgatggcgctcttgtgatatttcaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttgtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatctt

SEQ ID NO: 123610 - DNA, 632 bp, Homo sapiens
  Payload ID: 4266
  Gene Symbol: CCNT2
  Gene Name: cyclin T2
  ENST ID: ENST00000438691
  CDS Start-End: 1-202
gatccctgtatcaactgatggaaagcattggtgggaatatgtggatcctacagttactctagaattattagatgagctaacacatgagtttctacaaatattggagaaaacgcctaataggttgaagaagattcgaaactggagggtaagagaattgacagggtttaacagaatttcagtcttttatgtaacatttacatagctaaccagtttgaatttttgtggttaaataatctttgcagtattcctgaataattcaacgtatctcaagttacatatactcacatattcaactactgagtccagtggactttgctaaagtacattatacttttaaaaaattttttgcagtgattatgacaaaagtatcctcttcattttacaaatggggaaactgaagcctagacaagttaaattactttctgaagtgctgggctaggatttaacttgtatctgattctaaaatgggtgttttcaattttttatagccttttatgcctctaaggcatttatttactgacaacataaaatcttgaaccccaggtcattttatttccatatgtttaatatataatgtttttaatatataacttttataagacaagaaatttgcattaaattattttgctata

SEQ ID NO: 123611 - DNA, 4768 bp, Homo sapiens
  Payload ID: 4267
  Gene Symbol: CCNY
  Gene Name: cyclin Y
  Uniprot ID: Q8ND76
  ENST ID: ENST00000265375
  CDS Start-End: 406-1269
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacggtgaccccagtggctgaaagcaggagaaagtgtttcatcacgggccctctccttctgaatactatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatatatatcccgatgaatctttttgatttgttttacttttcttatttttttttttttaactagaaaaagggaaagaagaagtcaggagtttaaaaccaaattggagggcagatgagaaatcctgccaagatcgggatgtgccttcatgcatgaggtgaggccagaggtgtgggcacctgtacctgcctcctcttctgggctggctttcctgtctgcctgctctcgggcttgggcagagccatctccatcctggggtttcctttaagctaagctgaaagcaaaatttggggagtgaatgatttaaacttttcctgctgcttttggtaacttctcacctggggccatattttacagatttgaatttttttttttctttttttgagatggagtctcgctcttgtcacccaggctggtgtgcaatggtgcgatctgggctcactgcaacccccacttcccggattcaagcaattctgcctcagcctcccgagtagctaggatcacaggcacccaccaccatgcccagctgatttttgtagttttagtagagacagagtttcaccacgttggccaggctggtctcaaactcctgacctcaagtgatccacccccctcagcctcccaaagtgctgagattacaggcgtgagccactgcccctggcccagatttgaaattttttaaaaataaaacatgattcttggttattgtaggtatttaataaatgttaaataaatatatacatagaacaaagt

SEQ ID NO: 123612 - DNA, 4630 bp, Homo sapiens
  Payload ID: 4267
  Gene Symbol: CCNY
  Gene Name: cyclin Y
  Uniprot ID: Q8ND76
  ENST ID: ENST00000339497
  CDS Start-End: 181-1131
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatatatatcccgatgaatctttttgatttgttttacttttcttatttttttttttttaactagaaaaagggaaagaagaagtcaggagtttaaaaccaaattggagggcagatgagaaatcctgccaagatcgggatgtgccttcatgcatgaggtgaggccagaggtgtgggcacctgtacctgcctcctcttctgggctggctttcctgtctgcctgctctcgggcttgggcagagccatctccatcctggggtttcctttaagctaagctgaaagcaaaatttggggagtgaatgatttaaacttttcctgctgcttttggtaacttctcacctggggccatattttacagatttgaatttttttttttctttttttgagatggagtctcgctcttgtcacccaggctggtgtgcaatggtgcgatctgggctcactgcaacccccacttcccggattcaagcaattctgcctcagcctcccgagtagctaggatcacaggcacccaccaccatgcccagctgatttttgtagttttagtagagacagagtttcaccacgttggccaggctggtctcaaactcctgacctcaagtgatccacccccctcagcctcccaaagtgctgagattacaggcgtgagccactgcccctggcccagatttgaaattttttaaaaataaaacatgattcttggttattgtaggtatttaataaatgttaaataaatatatacatagaacaaagt

SEQ ID NO: 123613 - DNA, 3960 bp, Homo sapiens
  Payload ID: 4267
  Gene Symbol: CCNY
  Gene Name: cyclin Y
  Uniprot ID: Q8ND76
  ENST ID: ENST00000374704
  CDS Start-End: 181-1206
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatata

SEQ ID NO: 123614 - DNA, 3940 bp, Homo sapiens
  Payload ID: 4267
  Gene Symbol: CCNY
  Gene Name: cyclin Y
  Uniprot ID: Q8ND76
  ENST ID: ENST00000374706
  CDS Start-End: 323-1186
aggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatata

SEQ ID NO: 123615 - DNA, 793 bp, Homo sapiens
  Payload ID: 4267
  Gene Symbol: CCNY
  Gene Name: cyclin Y
  ENST ID: ENST00000490012
  CDS Start-End: 639-793
aggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagcactgtatacacagaagcttcccaaggaaaagctatgaactctacactttggaggaggttgaggcagtgggggtgagagaaggtgactcagggagttgtgcaaatgactgactcatatttcatggatacgagtatggctgatgtaagactgcagttatctcctcctgattcaattaagcacagggaatctactagagggccctgcctccacttccatcaaacaagggaagagaatgctcttcatgaggtcactgttaactgagccagcatagggaggctcagcagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcct

SEQ ID NO: 123616 - DNA, 816 bp, Homo sapiens
  Payload ID: 4267
  Gene Symbol: CCNY
  Gene Name: cyclin Y
  ENST ID: ENST00000493157
  CDS Start-End: 514-816
ggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagggtattaaaaaccagtgacatgtagcatgaaggcggatgaggcccatattgctaatgtgatgcagatgtggacgttcattgtggctttggtttttacccacaaaggctcacagggaatctactagagggccctgcctccacttccatcaaacaagggaagagaatgctcttcatgaggtcactgttaactgagccagcatagggaggctcagcagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcggtaatc

SEQ ID NO: 123617 - DNA, 3767 bp, Homo sapiens
  Payload ID: 4268
  Gene Symbol: CCNYL1
  Gene Name: cyclin Y-like 1
  Uniprot ID: Q8N7R7
  ENST ID: ENST00000295414
  CDS Start-End: 212-1291
gtgcggccgaggcccgagccctgcccggggccgggccgcggggcgggcgggcgaaccgcgggcgaggcggcgtctgcttgcgcggtgcagccccagcgtagcccggggctgccggtgccggccgcgccattgttgggggagggggcggctgttgagggcggcggagtagggggcgagcgaaggcggtggcagagaggagcggaggcttcccatggggaacacgctgacctgttgcgtgtcccccaatgccagccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgttttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactacactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatggtggcatgtgtctgtagtcccagccactctggaggctaaggtgggaggatcagtagagcccaggaggtcaaggctgcagtgggccatgatcatgtcactgctctccaacctgggcgacatccagaccctgtctcaaagaaaaaagcagaagaaaaatgttcagacaaggttttgtaaaggtttgtagcatttatatttctacaagtatcaaagcttaaaattacactgaacttttggaataccttgtatctccataaaatgccctctttttaaaagtagttacccgcagagctgtgctctatatgctttgattaccgcagtttctttaaaggaagattttgaagagcagtgttaattaacatgtaataaaaggaattggaccctaattatagaaggtgatatgaacagctgttttatcatcctacatgctaccaagctgtaggtgtcccattaagtcctgctatttaagaaatacttacataacccttaggaactcttcaggctttaaaaggcaaggagcaaataattttaggagaccgataatgtcacctaaatttgaaatactaagaagaggttagtgttctcaactatgtgaaatctgtttctcctactttctcaaatctaatcctaggaatcttgcttataaacaaagcatttctgggacaggagtacttcctctattatagcaatgcttcacatcatattgtgctgcagtttccatcatttttaaaggacagagacataaatgataaataatggtatacaaatattacaatctaccacctcaaaaaaacaaatattgtttatggaattcagagtttggagattcaagtattgattgcagttttattttgaaaagaatgctacaatttatgtggtttttatttctcatgtttatattaaaagctaataaactctattttaattaaaa

SEQ ID NO: 123618 - DNA, 2619 bp, Homo sapiens
  Payload ID: 4268
  Gene Symbol: CCNYL1
  Gene Name: cyclin Y-like 1
  Uniprot ID: Q8N7R7
  ENST ID: ENST00000339882
  CDS Start-End: 147-1073
ggcggcgtctgcttgcgcggtgcagccccagcgtagcccggggctgccggtgccggccgcgccattgttgggggagggggcggctgttgagggcggcggagtagggggcgagcgaaggcggtggcagagaggagcggaggcttcccatggggaacacgctgacctgttgcgtgtcccccaatgccagccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccattgtgaccttagcaatatattaccacataaagaacagcgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagatattttcataatgccaaccaacatggtggttcagtgacgatgagaaaaagtgaagcagttttaagcttgaatatagtttgggccctccaaggcactgcagcatgagtataaatgctataaacctttaaaaaacatgatttgaaagttttttgttttgttttgtttgtttttaaagagatgggggtcttactgcgttgtccaggctggagtgcagtggcttttcacaggtgcaatcattgtgcactcactgcagcctagaacttcctggtctcaagccatcctctagcctcagccacacaagtagctgggactacaagtgcaactggcacctgtctcctgaatattaagcttttaattttttgtttcggtcactcttgatagcagacattgactgaaacaaaaaattaaaagctttatattcaaaatttgcaaaatgaagctgggtgtggtggtgcacgcctatagtcccagctacttgggaggctgaggctggaggattgcttgaggtcaagtattggaggctgcagtgtaccatgatggtgcctataggaatagctactacactccaacctggacaacgttatcaagaccccatctcttagaaaaatgcaaaattaaatgcaaaagaaatgggctgggcatagtgattcatgcctgtaatctcagtaccctgggaggctgaggtggaaggattgcttgagtgcaggagttcaagaccagtctaggcaacatagtgagaccctgcctgtaaaaaaaaataataaaaatagttggatatgg

SEQ ID NO: 123619 - DNA, 1952 bp, Homo sapiens
  Payload ID: 4268
  Gene Symbol: CCNYL1
  Gene Name: cyclin Y-like 1
  Uniprot ID: Q8N7R7
  ENST ID: ENST00000392209
  CDS Start-End: 316-1185
gaggagctccagccgcgctctctcccggcagtggctgtgcttcacagcgcttgttgggttccccaccccttttaaataagccgggctggtcaccgccctcgcagacgagtcagcttaagggaggcggcggcagcgcggcggtggggccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagagatgcaaatagatccctggatatttttgatgagagatcacatccacttacacgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagaggctatttctagattgtgtgaagacaaagacttgtgtagagccgctatgagaaggtctttcagtgctgataacttcattggtattcagcgctctaaagccatcctctcttaaaaggagaaatgaggggttataacgtcatgggaccttcatctacaaagactggagaaataccacctttcctgctcaaaaaccagcaaaattagtgttttcatcaaaaggaaagatctcaaattcaagagactcatggacaacaaggattatactccacaggaaagaatgggaccttgtcaatgcaacaaaacactcttctgtcctttttaatgtaaacagagttacaaaaaccactccaaagtgaaggctcccatcctacacacagatatttgcttactgtgtgggccgatagctgtgaactatgtaaggttttttaaacaatagtttaaatttttagactttaaagacactaaccatataacttttatgtttcttccagtttctctccctccccccgcattttgctgcatatgcctttaaaatcaatgcagtattaccattaaaacatgggactctaactaaagccacttaggagcagacagcagcgttgttaggtactgaagggttcttcctccctactgttaccattgaagctgctagtcattggcaatcattttaaaccaaaaagctgctggataacatttgtcattcatattctttgcaagcattactttagcattttagcatgtttggggtcataaacagaggaagtatcagttattgatatctacttctattggagtccatgttgcatttcttgtgaactataaatggtgcttctcattttctgataatttttctcttgctaaataaatgtattaaaagat

SEQ ID NO: 123620 - DNA, 709 bp, Homo sapiens
  Payload ID: 4268
  Gene Symbol: CCNYL1
  Gene Name: cyclin Y-like 1
  ENST ID: ENST00000452312
  CDS Start-End: 1-358
ccgcgagatgcccgaagatttagctttggagtcaaacccttctgaccatccaagggcaagcacaattttcctgagcaaatctcaaacggatgtgcgagaaaagaggaagagcaaccatttgaaccatgtatctccagggcagcttactaaaaagtatagctcatgctcaacaatatttctagatgacagcacagtcagccagcctaatcttagaaccacagtaaaatgtgtgaccttagcaatatattaccacataaagaacagcgagaaaaagttccagaggaatactttaagcatgatcctgagcacaaatttatttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacc

SEQ ID NO: 123621 - DNA, 602 bp, Homo sapiens
  Payload ID: 4268
  Gene Symbol: CCNYL1
  Gene Name: cyclin Y-like 1
  ENST ID: ENST00000420321
  CDS Start-End: 1-444
atttacagatttgttcgtactctttttagtgctgcacagctaacagctgaatgtgcaatagtaactttggtttacttagaaaggcttttaacttatgctgaaatcgacatttgtcccaccaactggaaaaggattgttctgggagccattcttcttgcctccaaggtttgggacgatcaggctgtatggaatgtggactactgccagatcctcaaggacattacagttgaggacatgaatgaaatggaaaggcattttctggagcttcttcagtttaatattaatgttcctgccagtgtttatgccaaatactactttgaccttcgctccttagcagatgacaacaacctgaattttctatttgctcctcttagcaaagaaagagcacagaacctagagcttgtgactttgccctttgcccccttttccaatggggaaaaatgagtgacaagaaagcatggggaagatgtgctaactactgtgtcccggacatgtaaggtacagttgctcttctcttaggattcaactcaactatattttctagtctgcctctcctaactaccttatgcatcaatgtaataaacttcctagtgttcaccttg

SEQ ID NO: 123622 - DNA, 952 bp, Homo sapiens
  Payload ID: 4268
  Gene Symbol: CCNYL1
  Gene Name: cyclin Y-like 1
  ENST ID: ENST00000420822
  CDS Start-End: 250-555
gtcagcttaagggaggcggcggcagcgcggcggtgggggtgcggccgaggcccgagccctgcccggggccgggccgcggggcgggcgggcgaaccgcgggcgaggcggcgtctgcttgcgcggtgcagccccagcgtagcccggggctgccggtgccggccgcgccattgttgggggagggggcggctgttgagggcggcggagtagggggcgagcgaaggcggtggcagagaggagcggaggcttcccatggggaacacgctgacctgttgcgtgtcccccaatgccagccccaagctgggccggcgcgcggggtcggcggagctgtactgcgcgtccgacatctacgaggcggtgtccggggacgcggtggcggtagcgcccgctgtggtggagcctgccgagttggatttcggagagggcgagggccaccacctgcagcacatcagcgaccgcgagatgcccgaagagaaagagtctcactgtgttgaccaggctggcctcgaactcctggcctgggctcaagcagtcctcccacctcagcctcctgaatagctgggaccacgggcgtgtgccatcttgcctggctccatcttatgtctatacattcatttcagtggataagaataaaagtagaggtaacaaaatggcctaaatatacccatcaaataaacaggttgataaattttaaagagtttgttctggtaactgtgaattgaagctgagaatgcactggacagaggaatattagaagctggcaagagggaaggtaaggtaccaggcattaagcatgggatgatgataaagagtgctaaatcagaaaagttggaaaaagagaatttgtaagcacagaatttaccattgtatgttagtatgacagttacatttttatttcaatttgtctcaaaatttatttttgtggcattcaataaagtgataatagaaatctcca

SEQ ID NO: 123623 - DNA, 1733 bp, Homo sapiens
  Payload ID: 4269
  Gene Symbol: CDK1
  Gene Name: cyclin-dependent kinase 1
  Uniprot ID: P06493
  ENST ID: ENST00000316629
  CDS Start-End: 143-865
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgttt

SEQ ID NO: 123624 - DNA, 1613 bp, Homo sapiens
  Payload ID: 4269
  Gene Symbol: CDK1
  Gene Name: cyclin-dependent kinase 1
  Uniprot ID: P06493
  ENST ID: ENST00000373809
  CDS Start-End: 14-736
ccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 123625 - DNA, 1913 bp, Homo sapiens
  Payload ID: 4269
  Gene Symbol: CDK1
  Gene Name: cyclin-dependent kinase 1
  Uniprot ID: P06493
  ENST ID: ENST00000395284
  CDS Start-End: 143-1036
agcgcggtgagtttgaaactgctcgcacttggcttcaaagctggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgtttaacaaataa

SEQ ID NO: 123626 - DNA, 1948 bp, Homo sapiens
  Payload ID: 4269
  Gene Symbol: CDK1
  Gene Name: cyclin-dependent kinase 1
  ENST ID: ENST00000448257
  CDS Start-End: 202-1095
gctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaataacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttg

SEQ ID NO: 123627 - DNA, 723 bp, Homo sapiens
  Payload ID: 4269
  Gene Symbol: CDK1
  Gene Name: cyclin-dependent kinase 1
  ENST ID: ENST00000519078
  CDS Start-End: 155-723
agccgccctttcctctttctttcgcgctctagccacccgggaaggcctgcccagcgtagctgggctctgattggctgctttgaaagtctacgggctacccgattggtgaatccggggccctttagcgcggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtat

SEQ ID NO: 123628 - DNA, 1884 bp, Homo sapiens
  Payload ID: 4269
  Gene Symbol: CDK1
  Gene Name: cyclin-dependent kinase 1
  ENST ID: ENST00000614696
  CDS Start-End: 101-775
ggctcttggaaattgagcggagagcgacgcggttgttgtagctgccgctgcggccgccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagaaatttttttcctgttttttagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggagttgcttatcttggctttcgagtctgagtttaaaactacacattttgacatagtgtttattagcagccatctaaaaaggctctaatgtatatttaactaaaattactagctttgggaattaaactgttt

SEQ ID NO: 123629 - DNA, 3344 bp, Homo sapiens
  Payload ID: 4270
  Gene Symbol: CDK10
  Gene Name: cyclin-dependent kinase 10
  ENST ID: ENST00000331006
  CDS Start-End: 1742-2683
gttgtatgccacataagtaaccaaatttgcttgtcaattatgtcttttttttttcttttttctgagacagagtcttgctctgtggcccaggctggagtgcagtggtacagtcttggctcactgcaacctctgcctcccaggttcaagcgattctcatacctcagcctccagagtagctggactgcaggcgcatgctaccacggccagataatttttgtatttttaatagagacggggtttcttttttttttttttccctgacagagttttgcttttgttgcccaggcttggagtgcaatggcgcgatcttggctcactgcaacctccacttcctgggttcaagcaattcttctgcctcagcctcccaagtagctgggattacaggtgtacaccaccatgcctggctaattttgcatttttttagtagagacatggtttcaccatgttgatcagggtcgtctcaaactcctgacctcaagtgatccacccgcctcagtctcccaaagttttgggattataaatgtgcgccactgcacccggtcaagacagggttttgccatgttagccagggaggtctcaaactcctgacctcaagttatccgccctgcttggtctcccaaagtgctgggattgcacacatgagccactgtgcctggcctcaattatgtctttaactgtggctgttctaagacttttgtcatccacaattgttgttttacttttatcctttcacagagcagtttataatcagctatagaactctgaggtactcttcaatctaagtttctgatcacttttgagattgtgccattggaatagagcaaaaaacttccaagactctcattgagagctgctatattcatgaggattgttcatccaatattgggcaaaatgagagttaattttatggactaaactaatataagactgaaataatctttttatgtttttgcttaaaacattactgattctttctgttctttcagaaccaagaaaacttttttttttttttttttgagacagaatctcactctgtcgcccaggctggagtgcagtggcgccatctcggctcactgcaagctccgcctcccaggttcacaccattctcctgcttcagcctcccaagtagctgggactacaggcgcccaccaccgcgcccggctaattttttgtatttttagtagagacagggtttcaccgtgttagccaggatggtctcaatctcctgaccttgtgatccgcccacctcggcctcccagagtgctgggattacaggcgtgagccacggtgcccggctggtaacttttttaactttgagctatttgcagcttttagcaattgagtaaagtacactcctgtgaggaagatttggaacatatttctgttttcttttttgttttttatattttgcttgggtagcatatttctttctgatttctccaaaaattgggaactatctgtgagcactatttaaaaaaaaaaaaaaaacttttccctctcccttcccctatttgtattctaatgtcaatataatgatgtgtgcacgtgcagtaacaatctgttttctcttgtaataggacatagagacactgcatattttaccaaggctttgactggaatggcatgctttcaaatataaacagacggctttaaggaatcagagttgacctatagtgcccatcaaagcccttgggaaaactggcttcatactgtatccacccagtggattcttcttgcccagatggagcccatgtatcaagatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacag

SEQ ID NO: 123630 - DNA, 1798 bp, Homo sapiens
  Payload ID: 4270
  Gene Symbol: CDK10
  Gene Name: cyclin-dependent kinase 10
  Uniprot ID: Q15131
  ENST ID: ENST00000353379
  CDS Start-End: 44-1126
gcgtctgcgcctgcgcgcaagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagacatggtttca

SEQ ID NO: 123631 - DNA, 551 bp, Homo sapiens
  Payload ID: 4270
  Gene Symbol: CDK10
  Gene Name: cyclin-dependent kinase 10
  ENST ID: ENST00000502547
  CDS Start-End: 28-237
gcaagagaggcggggccagcgctcggcatggcggagccagatctggagtgcgagcagatccgtctgaagtgtattcgtaaggagggcttcttcacggtgcctccggaacacaggggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtg

SEQ ID NO: 123632 - DNA, 555 bp, Homo sapiens
  Payload ID: 4270
  Gene Symbol: CDK10
  Gene Name: cyclin-dependent kinase 10
  ENST ID: ENST00000508723
  CDS Start-End: 42-170
gtctgcgcctgcgcgcaagagaggcggggccagcgctcggcatggcggagccagatctggagtgcgagcagatccgtctgaagtgtattcggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaacc

SEQ ID NO: 123633 - DNA, 1424 bp, Homo sapiens
  Payload ID: 4270
  Gene Symbol: CDK10
  Gene Name: cyclin-dependent kinase 10
  Uniprot ID: Q15131
  ENST ID: ENST00000505473
  CDS Start-End: 217-1035
gtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctacgtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactcc

SEQ ID NO: 123634 - DNA, 707 bp, Homo sapiens
  Payload ID: 4270
  Gene Symbol: CDK10
  Gene Name: cyclin-dependent kinase 10
  ENST ID: ENST00000511415
  CDS Start-End: 32-202
gcgcgcaagagaggcggggccagcgctcggcatggcggagccagatctggagtgcgagcagatccgtctgaagtgtattcatcgtggctggatgacaacaggagccacactttactcatccagacgtgcagcaggcgctcaccgcgttgagagccgtgtgctggactctggggtgaagtactgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacaggtgggtgcaacttgggccaggccctgtccctagatggcacttggtgacacacactcccctctctgctgcagcggat

SEQ ID NO: 123635 - DNA, 658 bp, Homo sapiens
  Payload ID: 4270
  Gene Symbol: CDK10
  Gene Name: cyclin-dependent kinase 10
  ENST ID: ENST00000512912
  CDS Start-End: 22-231
gaggcggggccagcgctcggcatggcggagccagatctggagtgcgagcagatccgtctgaagtgtattcgtaaggagggcttcttcacggtgcctccggaacacaggggtctagcgctctcgcccaggctggaatgcagtggcgtgatcacggctcagtgcatcgtcagcctcctgggctcaagtgatcttcctgcctcggcctcccaagtgctggaattacaggcgtgagccaccgcccccagcctggcctggcatttctttgagttcaggaagtgtgacaaggatttggacacccagaaataagcgtgtcgagaagagcacaagcagaggatatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccac

SEQ ID NO: 123636 - DNA, 1376 bp, Homo sapiens
  Payload ID: 4270
  Gene Symbol: CDK10
  Gene Name: cyclin-dependent kinase 10
  ENST ID: ENST00000510811
  CDS Start-End: 21-149
aggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtcttt

SEQ ID NO: 123637 - DNA, 724 bp, Homo sapiens
  Payload ID: 4270
  Gene Symbol: CDK10
  Gene Name: cyclin-dependent kinase 10
  ENST ID: ENST00000565470
  CDS Start-End: 1-113
ctgaactgctgttgggaaccaccacgcagaccaccagcatcgacatgtgggcttttccaagctgccactggtcggccagtacagcctccggaagcagccctacaacaacctgaagcacaagttcccatggctgtcggaggccgggctgcgcctgctgcacttcctgttcatggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccc

SEQ ID NO: 123638 - DNA, 897 bp, Homo sapiens
  Payload ID: 4270
  Gene Symbol: CDK10
  Gene Name: cyclin-dependent kinase 10
  ENST ID: ENST00000564192
  CDS Start-End: 181-897
tcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccgg

SEQ ID NO: 123639 - DNA, 819 bp, Homo sapiens
  Payload ID: 4270
  Gene Symbol: CDK10
  Gene Name: cyclin-dependent kinase 10
  Uniprot ID: Q15131
  ENST ID: ENST00000617879
  CDS Start-End: 1-819
atggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctacgtcttccgatcagtggtgtctgtgaagggtgccgcgagccaggctga

SEQ ID NO: 123640 - DNA, 140 bp, Homo sapiens
  Payload ID: 4270
  Gene Symbol: CDK10
  Gene Name: cyclin-dependent kinase 10
  ENST ID: ENST00000625631
  CDS Start-End: 12-140
cagcgctcggcatggcggagccagatctggagtgcgagcagatccgtctgaagtgtattcgtaaggagggcttcttcacggtgcctccggaacacaggatcgggcccgggacacccagacagatgagattgtcgcactga

SEQ ID NO: 123641 - DNA, 2653 bp, Homo sapiens
  Payload ID: 4271
  Gene Symbol: CDK11A
  Gene Name: cyclin-dependent kinase 11A
  ENST ID: ENST00000356200
  CDS Start-End: 236-2476
tgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaa

SEQ ID NO: 123642 - DNA, 2446 bp, Homo sapiens
  Payload ID: 4271
  Gene Symbol: CDK11A
  Gene Name: cyclin-dependent kinase 11A
  ENST ID: ENST00000357760
  CDS Start-End: 81-2420
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123643 - DNA, 2419 bp, Homo sapiens
  Payload ID: 4271
  Gene Symbol: CDK11A
  Gene Name: cyclin-dependent kinase 11A
  Uniprot ID: Q9UQ88
  ENST ID: ENST00000358779
  CDS Start-End: 81-2393
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123644 - DNA, 2458 bp, Homo sapiens
  Payload ID: 4271
  Gene Symbol: CDK11A
  Gene Name: cyclin-dependent kinase 11A
  Uniprot ID: Q9UQ88
  ENST ID: ENST00000378633
  CDS Start-End: 81-2432
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagttaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123645 - DNA, 2429 bp, Homo sapiens
  Payload ID: 4271
  Gene Symbol: CDK11A
  Gene Name: cyclin-dependent kinase 11A
  ENST ID: ENST00000378638
  CDS Start-End: 163-2403
tgttttaactcaaatgggtgatgaaaaggactcttggaaagtgaaaactttagatgaaattcttcaggaaaagaaacgaaggaaggaacaagaggagaaagcagagataaaacgcttaaaaaataacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123646 - DNA, 450 bp, Homo sapiens
  Payload ID: 4271
  Gene Symbol: CDK11A
  Gene Name: cyclin-dependent kinase 11A
  ENST ID: ENST00000401096
  CDS Start-End: 340-450
gccgcggccccgtaggggtgagttccgactgggcggaccaggtgtgggagcgcgacgagaactgcgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaagtgttttaactcaaatgggtgatgaaaaggactcttggaaagtgaaaactttagatgaaattcttcaggaaaagaaacgaaggaaggaacaagaggagaaagcagagataaaacgcttaaaaaat

SEQ ID NO: 123647 - DNA, 2449 bp, Homo sapiens
  Payload ID: 4271
  Gene Symbol: CDK11A
  Gene Name: cyclin-dependent kinase 11A
  Uniprot ID: Q9UQ88
  ENST ID: ENST00000404249
  CDS Start-End: 81-2423
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123648 - DNA, 2306 bp, Homo sapiens
  Payload ID: 4271
  Gene Symbol: CDK11A
  Gene Name: cyclin-dependent kinase 11A
  ENST ID: ENST00000509982
  CDS Start-End: 15-1277
gtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagttaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123649 - DNA, 700 bp, Homo sapiens
  Payload ID: 4271
  Gene Symbol: CDK11A
  Gene Name: cyclin-dependent kinase 11A
  ENST ID: ENST00000479362
  CDS Start-End: 247-700
gactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcactgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagag

SEQ ID NO: 123650 - DNA, 2333 bp, Homo sapiens
  Payload ID: 4271
  Gene Symbol: CDK11A
  Gene Name: cyclin-dependent kinase 11A
  ENST ID: ENST00000460465
  CDS Start-End: 81-1304
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123651 - DNA, 2998 bp, Homo sapiens
  Payload ID: 4272
  Gene Symbol: CDK11B
  Gene Name: cyclin-dependent kinase 11B
  ENST ID: ENST00000341832
  CDS Start-End: 113-2461
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaggagaagaagatgattctttggccatcaaaccaccccagcaaatgtctcggaaagaaaaagctcatcacagaaaagatgaaaagagaaaagagaaacgtaggcatcgtagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaagagctgtgttttctccgtgacttgcccagggcggagagggtggacatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccagctgtgccagcagactcgacaggtttttatacaaggttgttgagttttaaaatgtattaaaatattcttcgaggaa

SEQ ID NO: 123652 - DNA, 2534 bp, Homo sapiens
  Payload ID: 4272
  Gene Symbol: CDK11B
  Gene Name: cyclin-dependent kinase 11B
  ENST ID: ENST00000340677
  CDS Start-End: 262-2508
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaataacaacgcttcttcggtgaagttcttttgtacttccaaatgtcgcagtctgatgaccgggattccaagcgggattcccttgaggagggggagctgagagatcaccgcatggagatcacaataaggaactccccgtatagaagagaagactctatggaagacagaggagaagaagatgattctttggccatcaaaccaccccagcaaatgtctcggaaagaaaaagctcatcacagaaaagatgaaaagagaaaagagaaacgtaggcatcgtagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123653 - DNA, 2677 bp, Homo sapiens
  Payload ID: 4272
  Gene Symbol: CDK11B
  Gene Name: cyclin-dependent kinase 11B
  ENST ID: ENST00000407249
  CDS Start-End: 113-2500
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaggagaagaagatgattctttggccatcaaaccaccccagcaaatgtctcggaaagaaaaagctcatcacagaaaagatgaaaagagaaaagagaaacgtaggcatcgtagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagttaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaa

SEQ ID NO: 123654 - DNA, 2227 bp, Homo sapiens
  Payload ID: 4272
  Gene Symbol: CDK11B
  Gene Name: cyclin-dependent kinase 11B
  ENST ID: ENST00000615951
  CDS Start-End: 113-724
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaggagaagaagatgattctttggccatcaaaccaccccagcaaatgtctcggaaagaaaaagctcatcacagaaaagatgaaaagagaaaagagaaacgtaggcatcgtagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123655 - DNA, 2350 bp, Homo sapiens
  Payload ID: 4272
  Gene Symbol: CDK11B
  Gene Name: cyclin-dependent kinase 11B
  ENST ID: ENST00000611150
  CDS Start-End: 113-847
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaggagaagaagatgattctttggccatcaaaccaccccagcaaatgtctcggaaagaaaaagctcatcacagaaaagatgaaaagagaaaagagaaacgtaggcatcgtagccattcagcagaaggggggaagcatgctagagtgaaagaaaaagaaagagagcacgaacgtcggaaacggcatcgagaagaacaggataaagctcgccgggaatgggaaagacagaagagaagggagatggcaagggagcattccaggagagaaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123656 - DNA, 2457 bp, Homo sapiens
  Payload ID: 4272
  Gene Symbol: CDK11B
  Gene Name: cyclin-dependent kinase 11B
  ENST ID: ENST00000626918
  CDS Start-End: 113-2431
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaacaggaaaagacgcagccctgggtgacaaaccaagaccctgtctcaaaaaaaagctagaaacaagaaggagcaaggacttcacagccagaaacaggccaatacagcaggaagatacagcaatgatacgtcactttgaaaagcggaggcaggcggatcacgaggtcaggagattgagaccatcctggctaacatgcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123657 - DNA, 2496 bp, Homo sapiens
  Payload ID: 4272
  Gene Symbol: CDK11B
  Gene Name: cyclin-dependent kinase 11B
  ENST ID: ENST00000629312
  CDS Start-End: 113-2470
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaaaccagcctggccaacatggtgaaaccctgtctctacaaaaatcacctggcctgggtgacaaaccaagaccctgtctcaaaaaaaagctagaaacaagaaggagcaaggacttcacagccagaaacaggccaatacagcaggaagatacagcaatgatacgtcactttgaaaagcggaggcaggcggatcacgaggctgaggcaggagaatcgctcgaacccgggaggcggagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123658 - DNA, 2490 bp, Homo sapiens
  Payload ID: 4272
  Gene Symbol: CDK11B
  Gene Name: cyclin-dependent kinase 11B
  ENST ID: ENST00000629289
  CDS Start-End: 113-2464
atacaggaagtgacgatacttttggcgcgcgccggttgctgtttcttctctggctccgggaccggcggcggcggcggcggcagcggcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcaccgcatggagatcacaataaggaactccccgtatagaagagaagactctatggaagacagaaaaacaagatctaactgtatgctgtctgctagagaacaggaaaagacgcagcgtacaaacatcagctctactcgggaggctcagaccctgtctcaaaaaaaagctagaaacaagaaggagcaaggacttcacagccagaaacaggccaatacagcaggaagatacagcaatgatacgtctactcgggaggctgaggcaggagaatcgctcgaacccgggaggcggagcaagcttctgtttagggggaatgatggcgtgtgcctcttcagggaccgcttggagcagttagaaaggaagcgggagcgggagcgcaagatgcgggagcagcagaaggagcagcgggagcagaaggagcgcgagcggcgggcagaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtgggttgcatcttcggggagctgctgactcagaagcctctgttccccgggaagtcagaaatcgatcagatcaacaaggtgttcaaggatctggggacccctagtgagaaaatctggcccggctacagcgagctcccagcagtcaagaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 123659 - DNA, 8336 bp, Homo sapiens
  Payload ID: 4273
  Gene Symbol: CDK12
  Gene Name: cyclin-dependent kinase 12
  Uniprot ID: Q9NYV4
  ENST ID: ENST00000447079
  CDS Start-End: 34-4506
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcagcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtgggggattgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactataccacttttgctccattgcatttacttcttaatctgtaccccctgagcatatctaatcatgtataaaggacgtttttcctccactttatcttaggggttctctgtctcagaatcattatagactcattaactccccctcccagcaaaaggttatcaggatttgaagaggtgcttgaaaacgctagactaggaactagagaataaatgagttgggaaaaaccatgaaatgtgatttttttaaagtagaaaagttatacaaataatggtaccaaaccatcaaaagagttgagcttcatgtaccctgactcctcctgacaggagaggtaagtgggtttgagctcaactgtcatcaagggaagttggtaagaggctgtttagacccaaaggatagtcttaaaccagacttcaccacccaccctacctcagttcccatgttattacatgcagagtcagcatggggattagtgtacctacctttgctgagatttcccgatgcgttgccaatccagaaagtgaatcaaaaagttgtttaaaagttaaaatctctattgtttccaaaatctttcccatctccacctgaagacagaattgcttccccttctc

SEQ ID NO: 123660 - DNA, 5918 bp, Homo sapiens
  Payload ID: 4273
  Gene Symbol: CDK12
  Gene Name: cyclin-dependent kinase 12
  Uniprot ID: Q9NYV4
  ENST ID: ENST00000430627
  CDS Start-End: 312-4757
cccggcgcccgggcctgaggactggctcggcggagggagaagaggaaacagacttgagcagctccccgttgtctcgcaactccactgccgaggaactctcatttcttccctcgctccttcaccccccacctcatgtagaagggtgctgaggcgtcgggagggaggaggagcctgggctaccgtccctgccctccccacccccttcccggggcgctttggtgggcgtggagttggggttgggggggtgggtgggggttgctttttggagtgctggggaacttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtgggggattgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaa

SEQ ID NO: 123661 - DNA, 871 bp, Homo sapiens
  Payload ID: 4273
  Gene Symbol: CDK12
  Gene Name: cyclin-dependent kinase 12
  ENST ID: ENST00000559663
  CDS Start-End: 1-479
ttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggtaggagcaacggtgggaatgccctctgaggaatgcagtgatgtccatcagtcacctctcacccagagcctggcaaattcagtctctttcacagaacctaaagccaagccaggttcagtgggaaatcccacctgtccaaacactgtgtgagacaccagaattagaggcctgcaagcctgcttccttcatccccaatgcccagatgggacaggtcaccagcctcctgtgtctacccccacctttcttgcttgctggcctcctctctctgcagtgcctctctcatccctgcaatccagacagcacatgcagcagctcaaatgtgaaaaacaagacccagagaggggaaatcatttgaatcctgtcctggtattgctttgtgttcctggatttggagaatttctgggaacacaggaaaaggaaa

SEQ ID NO: 123662 - DNA, 4165 bp, Homo sapiens
  Payload ID: 4273
  Gene Symbol: CDK12
  Gene Name: cyclin-dependent kinase 12
  ENST ID: ENST00000584632
  CDS Start-End: 562-4165
gtgtgactgggtctgtgtgagggagagagtgtgtgtggtgtggaggtgaaacggaggcaagaaagggggctacctcaggagcgagggacaaagggggcgtgaggcacctaggccgcggcaccccggcgacaggaagccgtcctgaaccgggctaccgggtaggggaagggcccgcgtagtcctcgcagggccccagagctggagtcggctccacagccccgggccgtcggcttctcacttcctggacctccccggcgcccgggcctgaggactggctcggcggagggagaagaggaaacagacttgagcagctccccgttgtctcgcaactccactgccgaggaactctcatttcttccctcgctccttcaccccccacctcatgtagaagggtgctgaggcgtcgggagggaggaggagcctgggctaccgtccctgccctccccacccccttcccggggcgctttggtgggcgtggagttggggttgggggggtgggtgggggttgctttttggagtgctggggaacttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacac

SEQ ID NO: 123663 - DNA, 7298 bp, Homo sapiens
  Payload ID: 4274
  Gene Symbol: CDK13
  Gene Name: cyclin-dependent kinase 13
  Uniprot ID: Q14004
  ENST ID: ENST00000181839
  CDS Start-End: 606-5144
gccccgcgggccgcagagtgcgcgaggccctaggccgggagttgttgtcaggcccaggccacttccgaggcgcctgcggtgtgtcgccgccaccacaggaggacgacgtcgacgccgaggaggaggcggtggaggcgtgttgttgtctcgcccactcccctcccctgaacttgcacccaacgtcagggcgcgatggagtgaagcggcgacgaaggtggtacttccgcgttgcgctgcccgagccgagagcgcggccaaggccgctcccccacccccgggggcacttggaggactcgggactcccccgcaggtcagcgcccggcgcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaagttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctgtaaaaacaggccctggacagcacttaaaccacagtgaattggcaattctactaaacctactacaatctaaaacaagtgttaatatggctgattttgtccaagtgttgaacattaaggtaaactctgagactcaacagcagctaaataaaataaaccttcctgctggaattttggcaacaggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaaaatggtcaacgttatttttgttttgttttgcagattatcaaagcctagcaaaatgcatttaaatgaaatagtgggttttatatgaaaactatgggtggggtggggagggaaagtaagtgccttaacaggtaagcttaaggtctgaaaaaaatagttaacttttacccccatttgtcttttaaagggaatcaatgcattaaaaaggcaagaaactctgaagtttcaggggctgcctgttcagttcctgttaggtccattccctctgcttgtcacactttctccttttctgcctgtctttgggctgtgttgcctttcactaccaccttctcttgataggggagtgagagcaaagaaagggagtagaactgcaatcagtacatattgtttgagaagttctacaaagttttgtcatttaaatggttgaaagtaatagctccaggagaattttagagtaccattttctttcaggctgccatattatccctgtttccatttgccatggataattggagggtcatggtatagaagcaagagttaataacagaacttgcctaaatgtgttaaagttcatgggggaggggtggcaaataccgtattttaagttatgcaattgcccttttaagaaagtcaattctattcacttgttaactagaaacattgcttagattgaatttattgaagcaaaaagaaaaggcaatgagagagaacttttatcttccttcctgtcacattctgtaaagttgattatgacttctgccagacttagagcaacaactttagttcattttaacatttttttttaatgaagagcatcaaagaatggagtagtccttatttaaactgtaatggtgtcaagtctcactgtgtgcacactctcacacatacacacacaattatactaattctagaaaggaaccaaaggtaaataaccagtgtttccattatcactaaatggaaaaattgactggaagttagagttgtgccaattaatcattttgttcatcaactgttctggtaacttatttttttttattggaatcttaaattggaacaactgttacagaatgtatattgctccagttctaaagccagttaaccctgtgccctctaacttatgaaccttcatttcaaaacagtatgtgggaagtcctgtagtttgataagagtaaaattattttaaagaggataatttaccattttactactataaaataagttgatatcagttgaccattttattttttgatggactctttttgttgggagaaagaaatgaatggaagaaaaaaatatgttgcttttatttgaatattgattactaacaacttataaactacattgcaggaaatgaagaaatattttgaaattagcaaaatagcaacagtattcaagtatctgaaattttaatatggtgagtcttagagctttagactttcctataagtgacagtatctaagttattcttaatagtcacacttgataattctgctgaccataagcagctaacctacagttgaagatatttatgtgacatgaatagcctgtgttttaaaaattaaatattttatataaaattgaa

SEQ ID NO: 123664 - DNA, 5066 bp, Homo sapiens
  Payload ID: 4274
  Gene Symbol: CDK13
  Gene Name: cyclin-dependent kinase 13
  Uniprot ID: Q14004
  ENST ID: ENST00000340829
  CDS Start-End: 133-4491
ggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaagttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccagcatcaagatatgaggatcttggagctaacgccagaaccagaccggcctcgaattctgcctcctgaccaacgacctcccgagcctcctgaaccaccaccagtcactgaggaagatctagattatcggacagaaaaccagcatgtacccaccaccagttcttcattaactgaccctcatgccggagtgaaggcagccctgttacagctgcttgctcagcatcagccccaggatgaccccaaaagagaaggtgggattgattatcaagcaggagacacttacgtgtccacttcagactacaaggacaactttggatcctcttctttctcttctgctccttatgttagcaatgatggtctaggaagcagttctgctccaccactagaacgacgtagtttcattggaaattcagatattcagtctttggataactacagtactgcttcatctcattctggtggtccacctcagccttctgccttttctgagtcatttcccagttcagtagctggatatggagacatttacctcaatgctggtcccatgttgtttagtggagacaaggaccatagatttgaatatagccatggtcctattgcagtcctggcaaacagcagtgacccttccacggggccagagagtactcatcctttgccagcaaagatgcacaactataactatggtggtaacttacaggaaaatccgagtggccccagcctcatgcatggacagacctggacttctcctgcccaaggacctggatattcacaaggatacaggggacatattagcacatcaactggcagaggcagaggcagagggttaccatactgagtatctgtttttcctcaggcacatcatttttatctggaaagacttttctagctgcaatttaaggcagcaatccaagagacttgaataataataattcaacaacagctttatttttatgtggagaagggtcttgcatacaatagtttaaaaaagacaaaaaaaacctttgcttaaattcatgctgttctaaaaactagatcgattgtacatcttcacaaattctagttaacaattttattttgtattcttgcagttttaagtggatgctaattttaggggcataagccttttatggccctcttgcagatcttctgaactatgcacatttgtgctttttttgtaagtttggaccaacttttatgtaacaaacagcccctccccacctccagttttacaacaatcagaaagggcactgatttatttggtatttttctttttacaaagctacctttagtcaaaggtcactgtcagtctttgcacctgctttcagtgttattgtgaaaggtgtactttgtgctcatttcagaaaataaaacacaacctttctcttgatgcaacagttttataaaaaaaaa

SEQ ID NO: 123665 - DNA, 3099 bp, Homo sapiens
  Payload ID: 4274
  Gene Symbol: CDK13
  Gene Name: cyclin-dependent kinase 13
  ENST ID: ENST00000613626
  CDS Start-End: 2125-3099
gcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgcgccgcgctctgcggctggctctaggcgatgccgagcagctcggacacggcgctggggggaggcgggggcctgagctgggcggagaagaagttggaggaacgccgcaagcggaggcgattcctgtcccctcagcagccgccgctgctgttgccgctcctgcagccgcagctcctgcaaccgccgccgcccccgccgcctctgctcttcctggctgctcccggcacggccgccgccgcagccgccgccgccgcggcctcctcctcttgcttcagcccgggcccccctctggaggtcaagcggctggcgagaggcaagaggcgcgcaggagggcggcagaagcggcgtcgcgggccccgcgccgggcaggaggcggagaagcgtcgggtcttctcgctgccccagccgcagcaggacggcggtggcggtgctagtagcggcgggggtgtgaccccgctggtggaatacgaggatgtgagctcccagtccgagcaggggctgctgctggggggggccagcgcggcaacggcggcgacggctgccgggggaacggggggcagcggcgggagtccggcctcctcctccggcacccagcggcgcggggaggggtcggagcgcaggccccgccgggaccgccgcagcagcagtggccgcagcaaggagcgccaccgcgagcaccggcggcgggatgggcagcgcggtggcagcgaggcctccaagtcccgcagccgccacagccacagcggcgaggaacgggccgaggtcgccaagagcggcagcagcagcagcagcggcggccgccggaaaagcgcttcggccacatccagcagcagtagcagccgcaaggaccgggactcgaaggcccaccgcagccggactaagtcgtccaaggagccgccttcggcctacaaggaaccgcccaaggcctaccgggaggacaagaccgagcctaaggcctacaggcggcggcggtccctcagcccactgggaggccgggacgacagcccggtgtcccacagggcctctcagagcctgaggagccgcaagtcccccagcccggcaggaggtggcagcagcccctattctcggcggctgccgcgctccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagacatgaagaaaatgaagtttctgataaacaaatctga

SEQ ID NO: 123666 - DNA, 2222 bp, Homo sapiens
  Payload ID: 4274
  Gene Symbol: CDK13
  Gene Name: cyclin-dependent kinase 13
  ENST ID: ENST00000611390
  CDS Start-End: 772-2028
tccccgagcccctacagtcgccgccgctcccccagctacagccgccacagctcctacgagcggggcggcgacgtgtcccctagtccctacagcagcagcagctggcgccgctctcgcagtccctacagccctgtgctcagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgatagcttacgaggaaatatttcagtaaaagcagttaaaaaagaagtagaaaagaaactccgatgtcttcttgctgatttaccgctgccccctgagctaccaggaggagatgatctttcaaagagtccagaggaaaagaaaacagcaacacagttacatagtaaaaggaggcctaaaatatgtgggcctcgctatggtgaaaccaaagaaaaagatattgactggggaaaacgctgcgtggataaatttgatatcatcggaattattggagaaggtacttacggacaagtttacaaagccagggataaagacactggagaaatggtagccttaaaaaaagtacgtctggataatgaaaaggaaggctttccaattacagcaattcgagaaattaaaattctccggcagcttacccatcagagtattatcaatatgaaggaaatagtgactgataaagaagatgctttggatttcaagaaggacaaaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataatagagggcagataaaacttgcagactttggacttgctcgattgtatagctcagaagaaagtcggccgtatactaacaaggtaattactttatggtaccgtccacctgaactgctactgggagaagaacgatacacaccagccattgatgtatggagctgtggctgtatccttggcgaactcttcactaaaaaacctatatttcaagcaaatcaggaacttgcacaactagaattaataagccgaatatgtgggagtccatgtcctgcagtgtggcctgatgtaatcaaactaccatatttcaacaccatgaaaccaaagaagcaatatcgtcgaaagttaagagaagaatttgtttttattcctgcagctgcgctagacttatttgattacatgcttgccttggatcctagtaagcgctgcactgctgaacaggctcttcagtgcgagttcctccgagatgtggaaccctcaaaatgcctccaccagatctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtgaaaaacagacagatccatcaacaccacaacaggagtcttcgaaaccgttgggagga

SEQ ID NO: 123667 - DNA, 4953 bp, Homo sapiens
  Payload ID: 4275
  Gene Symbol: CDK14
  Gene Name: cyclin-dependent kinase 14
  Uniprot ID: O94921
  ENST ID: ENST00000265741
  CDS Start-End: 145-1500
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 123668 - DNA, 4995 bp, Homo sapiens
  Payload ID: 4275
  Gene Symbol: CDK14
  Gene Name: cyclin-dependent kinase 14
  Uniprot ID: O94921
  ENST ID: ENST00000380050
  CDS Start-End: 132-1541
cgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 123669 - DNA, 5163 bp, Homo sapiens
  Payload ID: 4275
  Gene Symbol: CDK14
  Gene Name: cyclin-dependent kinase 14
  Uniprot ID: O94921
  ENST ID: ENST00000406263
  CDS Start-End: 443-1714
cttgacagcatatgcacggttactttggctgcaatgctgctgcagagcccggttactctgccttcgtgggaactccacaggcaagtccatcgtgtttggaaaaaaaaattagattttttggagaaaataattgagctgttaaagctattgatactgaatgttagcatgtcctttgagttcttctcaacagtttttggtcttattccactgagattagcttctcttaggggatttctgggcttttttttttttgcttgcttatgcatccccctctcttggttgtagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatct

SEQ ID NO: 123670 - DNA, 801 bp, Homo sapiens
  Payload ID: 4275
  Gene Symbol: CDK14
  Gene Name: cyclin-dependent kinase 14
  ENST ID: ENST00000431029
  CDS Start-End: 112-453
agttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacaga

SEQ ID NO: 123671 - DNA, 759 bp, Homo sapiens
  Payload ID: 4275
  Gene Symbol: CDK14
  Gene Name: cyclin-dependent kinase 14
  ENST ID: ENST00000449528
  CDS Start-End: 378-759
ccccgctgcaagttcttagattcctggaggatctgcagagtcaacattaggagtatccatccattcaccaaggccatcaggaatgtgctgaatgtgctgtaaagaagagttgtcaattgtgcacagaagataagaaatatatgatgaatagataattgaaaagagatcctccagaaagagcagaaggaagtttcttcaatgataccagtaacagcaattcaaagatgtgaatgggattaattcagggctgttgctcctgacagataagtcagtctacctgttgttgaatgacatgcagaaaagaaatttggtaagaagaaagtgatttgactttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 123672 - DNA, 565 bp, Homo sapiens
  Payload ID: 4275
  Gene Symbol: CDK14
  Gene Name: cyclin-dependent kinase 14
  ENST ID: ENST00000430760
  CDS Start-End: 184-565
ttcagggctgttgctcctgacagataagtcagtctacctgttgttgaatgacatgcagaaaagaaatttggtaagaagaaagtgatttgactttgaagaaagatgacaccacctttgatgagctttgatgattgccagaacaaagtgttggctctgcctggctctttgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 123673 - DNA, 4787 bp, Homo sapiens
  Payload ID: 4275
  Gene Symbol: CDK14
  Gene Name: cyclin-dependent kinase 14
  ENST ID: ENST00000436577
  CDS Start-End: 312-1334
tacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgt

SEQ ID NO: 123674 - DNA, 563 bp, Homo sapiens
  Payload ID: 4275
  Gene Symbol: CDK14
  Gene Name: cyclin-dependent kinase 14
  ENST ID: ENST00000446790
  CDS Start-End: 288-563
gcagcatgcatgatggtggctgaaacttggccttctataggatcccagattattatttaatggggttgtcactcaggacacttactggctttctccagtgctcttaaaaaattgaattgagcatgatgagtacggccgtaccatttcagcttgctagtgcagaaagatgtgaattcagttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctg

SEQ ID NO: 123675 - DNA, 620 bp, Homo sapiens
  Payload ID: 4275
  Gene Symbol: CDK14
  Gene Name: cyclin-dependent kinase 14
  ENST ID: ENST00000456689
  CDS Start-End: 239-620
ttcagggctgttgctcctgacagataagtcagtctacctgttgttgaatgacatgcagaaaagaaatttggtaagaagaaagtgatttgactttgaagaaagatgacaccacctttgatgagctttgatgattgccagaacaaagtgttggctctgcctggctctttgatcctgaggtgacttccttctaagtttttcctccaaagctaccaaataaaccctaatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggga

SEQ ID NO: 123676 - DNA, 590 bp, Homo sapiens
  Payload ID: 4275
  Gene Symbol: CDK14
  Gene Name: cyclin-dependent kinase 14
  ENST ID: ENST00000446224
  CDS Start-End: 210-590
ttcagggctgttgctcctgacagataagtcagtctacctgttgttgaatgacatgcagaaaagaaatttggtaagaagaaagtgatttgactttgaagaaagatgacaccacctttgatgaggctgtggaagtgattctgattctctgccagggttgtgacgctgcagctttccatgaagtacttcacaagtagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaaggg

SEQ ID NO: 123677 - DNA, 1635 bp, Homo sapiens
  Payload ID: 4276
  Gene Symbol: CDK15
  Gene Name: cyclin-dependent kinase 15
  Uniprot ID: Q96Q40
  ENST ID: ENST00000260967
  CDS Start-End: 204-1358
tgtggccagaacaagaaccttaactgtgccaaattttattctattcaataacagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaaga

SEQ ID NO: 123678 - DNA, 1780 bp, Homo sapiens
  Payload ID: 4276
  Gene Symbol: CDK15
  Gene Name: cyclin-dependent kinase 15
  Uniprot ID: Q96Q40
  ENST ID: ENST00000410091
  CDS Start-End: 350-1504
agataaggcccagactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgaggagtctttgtttacagtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaag

SEQ ID NO: 123679 - DNA, 1437 bp, Homo sapiens
  Payload ID: 4276
  Gene Symbol: CDK15
  Gene Name: cyclin-dependent kinase 15
  ENST ID: ENST00000451080
  CDS Start-End: 468-632
agataaggcccagactgaacactgggtccactcaaattaggaagttgagcaggggaggaggaatcagcaaagatggttgcagaggagtccccagagaggcaggaggaaaaccaaggaagtgcccacttcacagaatcaaggaggctttcaaaaagggtggcatgattatggtgttaaatgccaccaaagagtaaagcaaggatcttgctctgtcacccagtctgaagtgctgtggcacaaccatggctctatgcagccttgacctcctgaactcaagcaattgtcctacctcagccttcccagttgctaggaccacagctgcctcgttttcagttgtgcacatctgaatgcaagcaatccctgtctgatgtggagtttcttgcactgataaggaaaaactgctgaagttgtgaggctgctccaggcagagccatcatctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggagcagaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggaggaagagacttcacttgcccgctttgccctggtgaccacctctaccggcgaaggagaa

SEQ ID NO: 123680 - DNA, 3659 bp, Homo sapiens
  Payload ID: 4276
  Gene Symbol: CDK15
  Gene Name: cyclin-dependent kinase 15
  Uniprot ID: Q96Q40
  ENST ID: ENST00000450471
  CDS Start-End: 87-1376
ctctggcaaaaagggagagaacaaggataggagaggcagtgggggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgtttcaggagtgaggctaaagccagaaatgtgtgaccttttggcctcctaccagaaaggtcaccacccagcccagtttagcaaatgctggtgaaaagaaagggcgagatcaccaaggttcttccagggctgtatttctgcagtttcggttttcatttgcttcagcttactaagaagcttcaaatctaactccatactgaacaaggggctttatgtcctcacctatgacctggaatagtttaaatatggtgttcaaggcaatagtacataatagtggaagaaaattcagtggaaggttattgctattgtcatttgcatagaatttaagtgattgatttaaaaaaactggacataaactaagtctaagaagagggcttctgaataacttcattcattttggcatttgttaagagattcctgggctagaaggttgatttcccaaaaagacagataagagactgacaatttaaaagaatctggagacagagctggtgcttacagagacctgccactcctgtgttcacttacaatttctcccaacaaaaggatttctgtggcaaggagaaaactagcctaaagtttagaaaaagatggtttcttggataacattgttaacaaaaggacttcctgaggactatttattattattttgtagggggcacttcctccttcactaaactggattatcagaacgtattaccacccaacccatattttagaagtttggatttggctgctgattagaaatgaatttcaggctatctcctcctactgaatcttaattgtctgtgatgatggcaacagtgatggggaatctaagcgctggtttgatggtggagatattgaataagtagttgggagcagagttccaaagatgtaatttaagccctgttgcaccaccacacacacacacacacacacacacacacacacacacacacccctcaagtaaaatgagagatctgtcttagctaacacgtgtgccgttttatacaatgactccttctaaaagcagccagggaaactcaaatcgcttctgtccagggatcatctcaggaaatgtagcagcctagaaaccagagacctctgtatatcctttggaagagcaaggaggaactaattaagagataattaaaaaatagtaactatcccccaatgtctgagatggaaaaaggaaaaagacacatgggtagcccaaatcaacctgcctgagtaagtatctgattttagtaaggcatttgacaaagactgtccagctatacctgaaagatgaaacagtgtaggctgggtgatggagcagatatatgtactcaaatcatggtgtttatttaacccagagaaaggccagccgtggtgtgctacaaggttcagtcttgagtcctattctggtcaaatatttttattaattactcgaataaatcagagtacatggacaactttatacaactccttgaagtaagtactattattattaatttatgacttccatttcacaaaagaggagactgaggctcagtgaagttaggtaactccttcatagtagcatgccagagtgaagatgcaaacctcagacctggttctccaatgttcctgacacctatcgaatttagagaatacacaactcttgcagaggcagctgctatttagtattggatcatgattcaaaagacaccttgctagaagccaatgaacagcaggccaaaacaacacttacttgcatcaaatttcatctgacttaaattcttacactttgggctacaacttaaaaaaggctatgacttagtggaaattggcacttttaagtacaatatgaattaatagtataatttcgctgtcccccagagataatgctagtaccaatcgaaagctcagggatgctactgttgacgcatcagcaagagttcttgagcagttttacctgtccatcaatacaaagagttcccacaacagtagtgggattcctctgcctctctgaagatatgagagctataggagggattcccatgttggaggttagaagagctgacctccaatgtcccgtctaattccaagattctccaataatgactttggaacagctgtgtacagattatacttggaattatgcttagatactattgctgcaggaatgaatagacaaattttgttattaaaaaattgattttattaagtggaagttgacagaattatcctctttataatggaggaacattatgcttatgcatatgcatataccttatgcatatgattatgcttgtgcttccttctttaatggatttacctattcaaaagcttaataaatgttataagactctaaaacatttaaatctttcatttctcaattttatcaaataaacattcctggaatttgtgcata

SEQ ID NO: 123681 - DNA, 2240 bp, Homo sapiens
  Payload ID: 4276
  Gene Symbol: CDK15
  Gene Name: cyclin-dependent kinase 15
  Uniprot ID: Q96Q40
  ENST ID: ENST00000434439
  CDS Start-End: 45-1247
gggaaaggttcaagtgcgggttttctccttgaacctacaagattatgggtcaagagctgtgtgcaaagactgtacagcctggatgcagctgctaccattgttcagagggaggcgaggcacacagctgtcggaggagtcagcctgagaccacggaggctgcgttcaagctaacagacctaaaagaagcatcatgttccatgacttcatttcaccccaggggacttcaagctgcccgtgcccagaagttcaagagtaaaaggccacggagtaacagtgattgttttcaggaagaggatctgaggcagggttttcagtggaggaagagcctcccttttggggcagcctcatcttacttgaacttggagaagctgggtgaaggctcttatgcgacagtttacaaggggattagcagaataaatggacaactagtggctttaaaagtcatcagcatgaatgcagaggaaggagtcccatttacagctatccgagaagcttctctcctgaagggtttgaaacatgccaatattgtgctcctgcatgacataatccacaccaaagagacactgacattcgtttttgaatacatgcacacagacctggcccagtatatgtctcagcatccaggagggcttcatcctcataatgtcagacttttcatgtttcaacttttgcggggcctggcgtacatccaccaccaacacgttcttcacagggacctgaaacctcagaacttactcatcagtcacctgggagagctcaaactggctgattttggtcttgcccgggccaagtccattcccagccagacatactcttcagaagtcgtgaccctctggtaccggccccctgatgctttgctgggagccactgaatattcctctgagctggacatatggggtgcaggctgcatctttattgaaatgttccagggtcaacctttgtttcctggggtttccaacatccttgaacagctggagaaaatctgggaggtgctgggagtccctacagaggatacttggccgggagtctccaagctacctaactacaatccagaatggttcccactgcctacgcctcgaagccttcatgttgtctggaacaggctgggcagggttcctgaagctgaagacctggcctcccagatgctaaaaggctttcccagagaccgcgtctccgcccaggaagcacttgttcatgattatttcagcgccctgccatctcagctgtaccagcttcctgatgagtgaagcagctgcgataattatgctgtcagcctcgggaagctaatgaggagtcaccagagtggaaggttttgcatttgtgagattgctgaaggagagccgcgctgcagcttttttcgttttttatttccctttctttctttcttcctcctttttctttttctatgagttgggaaggagagtctggcagtccacagccaaattggaatccttttgattaaccggttgccttcccagcatgttctgccagatagtgtctctctctctctccctccctccctgcttttgaggagctgctgcttttgaggggcaaggaagccggagggaaatcccagcttttcatgccactgtccccaaggcaagaggatacttctccccgagagaagttccccaaatggtttggatttgagttgatttgagaataattggtaaagtatacgcactgtttattttagccatttaactgtctatgctatgacaagatctaatagaaagtagaatacaaaattgcatattataatatccgtgtgaaaatgtcttatgcatatcaacaaatggtatgatggctcccctttccagcctatttggaatatgcgattccaaatacaagacaacgagaccccagattacccacagcatttaagggcagaagtttaggccaggcgaggcagagctggcaagtttatttcttccctttgggtgtgagcagcttccagcaaacagtattatttaaggcattttatgcttttggtgcagtaataacagaaggctctctttttgttaaattgtgagatattttgagcaccccagatttatgcaaattgtgaacctgggaaaagcaatgcccaagtggaaaggggccctgagtaaattttgcggatgtgctttggtgacaatgtggctgctgcctcttgctatttttctcagatatctgtgctaatacttgtaacaatggctaccatttattaaaaacatattgtgtatcataaactaacacaa

SEQ ID NO: 123682 - DNA, 3016 bp, Homo sapiens
  Payload ID: 4277
  Gene Symbol: CDK16
  Gene Name: cyclin-dependent kinase 16
  Uniprot ID: Q00536
  ENST ID: ENST00000276052
  CDS Start-End: 79-1791
tagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 123683 - DNA, 3144 bp, Homo sapiens
  Payload ID: 4277
  Gene Symbol: CDK16
  Gene Name: cyclin-dependent kinase 16
  Uniprot ID: Q00536
  ENST ID: ENST00000357227
  CDS Start-End: 425-1915
acccttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 123684 - DNA, 3158 bp, Homo sapiens
  Payload ID: 4277
  Gene Symbol: CDK16
  Gene Name: cyclin-dependent kinase 16
  Uniprot ID: Q00536
  ENST ID: ENST00000457458
  CDS Start-End: 421-1929
ggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaa

SEQ ID NO: 123685 - DNA, 1266 bp, Homo sapiens
  Payload ID: 4277
  Gene Symbol: CDK16
  Gene Name: cyclin-dependent kinase 16
  ENST ID: ENST00000523344
  CDS Start-End: 1-783
gacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccggtctctttgtccttgtggcagacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttg

SEQ ID NO: 123686 - DNA, 943 bp, Homo sapiens
  Payload ID: 4277
  Gene Symbol: CDK16
  Gene Name: cyclin-dependent kinase 16
  ENST ID: ENST00000520893
  CDS Start-End: 485-943
gcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagc

SEQ ID NO: 123687 - DNA, 785 bp, Homo sapiens
  Payload ID: 4277
  Gene Symbol: CDK16
  Gene Name: cyclin-dependent kinase 16
  ENST ID: ENST00000518391
  CDS Start-End: 218-785
taccttgtttagggttgttcaatgaatagcagggactcatcacctcagcagaggttggtcctaggccctcagccccctgattcacttatttctgccataagcactttttgagcatctactctgtgtcagtcactattccaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaacc

SEQ ID NO: 123688 - DNA, 991 bp, Homo sapiens
  Payload ID: 4277
  Gene Symbol: CDK16
  Gene Name: cyclin-dependent kinase 16
  ENST ID: ENST00000519758
  CDS Start-End: 542-991
cttccgagcgcctgcgtgcgcatgcgcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgtcactattccaggtcctcaggatatagccgtgacctaaacacagaaatctaccctggcggagctgatcttctagttgtggcggtgaggagatagacagtaaagactaaagaaaccaataaatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgt

SEQ ID NO: 123689 - DNA, 2022 bp, Homo sapiens
  Payload ID: 4277
  Gene Symbol: CDK16
  Gene Name: cyclin-dependent kinase 16
  Uniprot ID: Q00536
  ENST ID: ENST00000518022
  CDS Start-End: 310-1800
gatgagtgctagagaagtcaggaagagggtccctgtggccacagggaatagtctgccttggcctttgagggtggtgctaggggaactatgccactctatggccgtgctcgagaccatgtcacccatccttcaattctgggcacacgccctggccgacccatggctgggcccatcactgcagctgtacctgagaagatctgcaatggagccttctgctcctgcagtggggcttttcccctagatcccaacaatccatcgttagggcccttgccctcaatcagccacctaaatctgagaactcagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttc

SEQ ID NO: 123690 - DNA, 1574 bp, Homo sapiens
  Payload ID: 4277
  Gene Symbol: CDK16
  Gene Name: cyclin-dependent kinase 16
  ENST ID: ENST00000517426
  CDS Start-End: 395-1574
ggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttagtattttgtgcaatgaagccctgctcccagcctttcagagacaggg

SEQ ID NO: 123691 - DNA, 454 bp, Homo sapiens
  Payload ID: 4277
  Gene Symbol: CDK16
  Gene Name: cyclin-dependent kinase 16
  ENST ID: ENST00000523034
  CDS Start-End: 1-454
ccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggca

SEQ ID NO: 123692 - DNA, 664 bp, Homo sapiens
  Payload ID: 4277
  Gene Symbol: CDK16
  Gene Name: cyclin-dependent kinase 16
  ENST ID: ENST00000462827
  CDS Start-End: 1-253
acttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatggga

SEQ ID NO: 123693 - DNA, 573 bp, Homo sapiens
  Payload ID: 4277
  Gene Symbol: CDK16
  Gene Name: cyclin-dependent kinase 16
  ENST ID: ENST00000520295
  CDS Start-End: 267-518
tttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagattgtgcacgaggacttgaagatggggtctgatggggagagtgaccaggcttcagccacgtcctcggatgaggtgcagtctccagtg

SEQ ID NO: 123694 - DNA, 498 bp, Homo sapiens
  Payload ID: 4277
  Gene Symbol: CDK16
  Gene Name: cyclin-dependent kinase 16
  ENST ID: ENST00000520141
  CDS Start-End: 1-498
acttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcagccatctgctctgctttcccccacaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttca

SEQ ID NO: 123695 - DNA, 601 bp, Homo sapiens
  Payload ID: 4277
  Gene Symbol: CDK16
  Gene Name: cyclin-dependent kinase 16
  ENST ID: ENST00000522883
  CDS Start-End: 431-601
gaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgaggtcctcaggatatagccgtgacctaaacacagaaatctaccctggcggagctgatcttctagttgtggcgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgt

SEQ ID NO: 123696 - DNA, 2968 bp, Homo sapiens
  Payload ID: 4277
  Gene Symbol: CDK16
  Gene Name: cyclin-dependent kinase 16
  ENST ID: ENST00000622098
  CDS Start-End: 397-1743
gcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtg

SEQ ID NO: 123697 - DNA, 4157 bp, Homo sapiens
  Payload ID: 4278
  Gene Symbol: CDK17
  Gene Name: cyclin-dependent kinase 17
  Uniprot ID: Q00537
  ENST ID: ENST00000261211
  CDS Start-End: 605-2176
gcgggggtggggtaagctcccgcggccggtcgcttttctccgccgccgctggttggatcgtttcaataaaagtgttttttctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatata

SEQ ID NO: 123698 - DNA, 1769 bp, Homo sapiens
  Payload ID: 4278
  Gene Symbol: CDK17
  Gene Name: cyclin-dependent kinase 17
  ENST ID: ENST00000542666
  CDS Start-End: 131-1543
gcatccggtcgccgcgggcgtccgcggagcagcttccccccgcgcctctcttcgcctcgcctcgggacccgcggtccccgctcttgctgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggtgtgtttgtcataaaccatttcacgtgtcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctg

SEQ ID NO: 123699 - DNA, 2442 bp, Homo sapiens
  Payload ID: 4278
  Gene Symbol: CDK17
  Gene Name: cyclin-dependent kinase 17
  Uniprot ID: Q00537
  ENST ID: ENST00000543119
  CDS Start-End: 525-2096
ctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggtgtgtttgtcataaaccatttcacgtgtcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctggcttgatcactgcacacgccatccctggtacctgaggcagaagacacatcttgtgcttccctagtcatcaggttcatcacttcgaagcatagaagctgtagactgaccccgtcaacagaa

SEQ ID NO: 123700 - DNA, 583 bp, Homo sapiens
  Payload ID: 4278
  Gene Symbol: CDK17
  Gene Name: cyclin-dependent kinase 17
  ENST ID: ENST00000552496
  CDS Start-End: 101-583
aaagatcagggcagcctcctgctggcgggtcacaccccggagtgttggtcaagagcggaggtagagggaaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttg

SEQ ID NO: 123701 - DNA, 556 bp, Homo sapiens
  Payload ID: 4278
  Gene Symbol: CDK17
  Gene Name: cyclin-dependent kinase 17
  ENST ID: ENST00000548734
  CDS Start-End: 169-556
atataatgattgatatttatgttatggaacctaagcatcaaaataatattgatattttactataatggtttttaaaatacacattttaagaaaatttccaatccttctaaacttatttgtgatgcttaaagtcccactctttagttacatggaattcctgctcttctgatgatgccaaataaatacagcattattcggagatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtg

SEQ ID NO: 123702 - DNA, 566 bp, Homo sapiens
  Payload ID: 4278
  Gene Symbol: CDK17
  Gene Name: cyclin-dependent kinase 17
  ENST ID: ENST00000552262
  CDS Start-End: 302-566
agtgttggtcaagagcggaggtagagggaaggtgggaaacccagcaaaccgatggggaggggaaaatggggggaggagggtgcctagtgctgtctccgtcgcagttgcttttctcagcatttttgtgcccgatgctatgcccgatgcttttgctccccaactcagctggatagctccagattccctccctcctgtcacccccacactgccacattgactctcctgtggtttttccctcgttctccccctacttttcacccactccttttcgggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgccca

SEQ ID NO: 123703 - DNA, 626 bp, Homo sapiens
  Payload ID: 4278
  Gene Symbol: CDK17
  Gene Name: cyclin-dependent kinase 17
  ENST ID: ENST00000551816
  CDS Start-End: 90-626
aaagatcagggcagcctcctgctggcgggtcacaccccggagtgttggtcaagagcggaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagct

SEQ ID NO: 123704 - DNA, 3141 bp, Homo sapiens
  Payload ID: 4279
  Gene Symbol: CDK18
  Gene Name: cyclin-dependent kinase 18
  Uniprot ID: Q07002
  ENST ID: ENST00000360066
  CDS Start-End: 302-1726
cttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtacagaaagga

SEQ ID NO: 123705 - DNA, 949 bp, Homo sapiens
  Payload ID: 4279
  Gene Symbol: CDK18
  Gene Name: cyclin-dependent kinase 18
  ENST ID: ENST00000419301
  CDS Start-End: 99-949
tcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgc

SEQ ID NO: 123706 - DNA, 591 bp, Homo sapiens
  Payload ID: 4279
  Gene Symbol: CDK18
  Gene Name: cyclin-dependent kinase 18
  ENST ID: ENST00000443813
  CDS Start-End: 114-591
ttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgg

SEQ ID NO: 123707 - DNA, 1648 bp, Homo sapiens
  Payload ID: 4279
  Gene Symbol: CDK18
  Gene Name: cyclin-dependent kinase 18
  Uniprot ID: Q07002
  ENST ID: ENST00000429964
  CDS Start-End: 224-1648
tttccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctga

SEQ ID NO: 123708 - DNA, 1134 bp, Homo sapiens
  Payload ID: 4279
  Gene Symbol: CDK18
  Gene Name: cyclin-dependent kinase 18
  ENST ID: ENST00000512922
  CDS Start-End: 229-447
ttccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtca

SEQ ID NO: 123709 - DNA, 794 bp, Homo sapiens
  Payload ID: 4279
  Gene Symbol: CDK18
  Gene Name: cyclin-dependent kinase 18
  ENST ID: ENST00000462976
  CDS Start-End: 219-437
ccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccc

SEQ ID NO: 123710 - DNA, 782 bp, Homo sapiens
  Payload ID: 4279
  Gene Symbol: CDK18
  Gene Name: cyclin-dependent kinase 18
  ENST ID: ENST00000478560
  CDS Start-End: 241-782
caggttgcagcttctctggggaactgctcacctttccggagcaggggaagctgccccgtgcccgggagggagcgggcgcaccgcggcccccaggacacgcgctacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaa

SEQ ID NO: 123711 - DNA, 2143 bp, Homo sapiens
  Payload ID: 4279
  Gene Symbol: CDK18
  Gene Name: cyclin-dependent kinase 18
  Uniprot ID: Q07002
  ENST ID: ENST00000506784
  CDS Start-End: 221-1735
ccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagaacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccag

SEQ ID NO: 123712 - DNA, 2435 bp, Homo sapiens
  Payload ID: 4279
  Gene Symbol: CDK18
  Gene Name: cyclin-dependent kinase 18
  ENST ID: ENST00000504648
  CDS Start-End: 448-666
tccttcctcctcctcctcctcctcctcctccctcctcttccccaccttcctccactccctcccttcccctccccttctacctcctcctcggccagctcaggttgcagcttctctggggaactgctcacctttccggagcaggggaagctgccccgtgcccgggagggagcgggcgcaccgcggcccccaggacacgcgctgtgagtcccgcgggcggtgcgcctgggaggaagggggaggtcggaggagcgggcaccgcggcgccgggtataaggagcaaagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcct

SEQ ID NO: 123713 - DNA, 3756 bp, Homo sapiens
  Payload ID: 4279
  Gene Symbol: CDK18
  Gene Name: cyclin-dependent kinase 18
  ENST ID: ENST00000515494
  CDS Start-End: 746-964
ccttccactgctcctgacctcctgtatttcagctggagagaaggtgcagctggccagctctgatgcactcttcccttcctcctctttttcccctcttgcctcctggggcatgccagagcagagaccttcaggtgtcagtatcagaggtgaaatgaggtttggacccaatcatgtcccaagggtgttggccaagctgacattcagtttacgggccttggtcagtaagatttattggctgttgacacattcaggcccttggacacaagttggtaaatttctgctggtccaaggactgcctggttctggcaccctccctgccaccccagcccttcccccagaactctctagacctccagcagctaaagggcttaggtctggggggccttcaggatcctctttgcacatcatgcctgctattatgaccaatactttgctggactaggtggtccatagagaactgcacagggcgtggcggggcgggcggtgggcagtggaggcagtgctgagggtcactgggaggaagaaggtgactgggaagaagagggtgaacacccaccctcagaggggtcaaactttgcagaagacacaaccctggctcccagtgatggtggcatacagggcgacagagcttgatgagagagctgaattcccagtgggtggagacctggactggttgccttgttcttttcaactgctcttctcacacttcccatctcaggacccggctgcccagtccctcatgatcatgaacaagatgaagaactttaagcgccgtttctccctgtcagtgccccgcactgagaccattgaagaatccttggctgaattcacggagcaattcaaccagctccacaaccggcggaatgagagtgaggggtctgggcccacccagcacctctcccacctaccagacactccccagtcaccttcccctccccgcccaccccctccccactggccttaggggaggagcacagcgctgggggaggggggctacccttctctccctcaggacagagaggcagggaggggagctgacgcctgtccctcttagacttgcagctcggtcctcttggcagagaccccccgcaggagtgcagcaccttctccccaacagacagcggggaggagccggggcagctctcccctggcgtgcagttccagcggcggcagaaccagcgccgcttctccatggaggacgtcagcaagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcaccaccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgatatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcctgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagatcacatggagcacaaattcgggtaggatggagcctgtgtggccctcggaggactgaagaacgagggctgacagccagcctggaagaccgcttggcagcccttctggccacggctgtttcttctttgtgcttcccgtgtgcctccccagtagccctcacctgcataccaacccctcctttacccacgttggggctggcataagctgcttccctgagaggacatgaggggggggcggtcctcgtaccctctcccaccctggtgtttgggcacctgcgtgggatgcacacggatgacagaatcaaggcgccaggatgggcactctgccctggatacaggctctaccctcctcccccaggacctgcctagtgccagtttggtagtccccctttctggccccttggagcccacacacgtttcatctttttcccctctgagagcaagaagagacatggcatgttctctgggaccctggaatcctaggtacccacatgtgtgccaaagcctaccccacctggcaggtgtcccacagcaacagaaggaatagtagtccccactctttccatcagccctaccctaccctcattccccgacaccctctggcttgaaccatggctgagcagtgccggcatacgctttgctggcatgcttggatgcccagctgtgtccagaggtggcctgggaccgccagttgcacgcctgccacctcagccagcccccgcccagctcatcagtctgaatggagttgccttaaattggcaggtggtaccgtactcactgcccttggagctgtgaccggctcctgcctgtccaccccttcccgaggtggctcctgcttaccttatcatcccagggctctgattagccaggcctggtcagggtcctggggacggcacccagatatgcagagtcaccctgacactggtgccaggctgacctcagctcccgaaggctcgcacagcctccccatccttccttcccagcccttgtggctctgtccacctgatcccaataccagcttcccccagcccctgccaccccagagggcggccacgacagggagaggtgtagatgccaccatctgagggagaggaacgtggaacaggagcaggctctgatgctgagaggcttgcctccgggggctggaagcctgggtggccggggcccctgaagaaggctcccctctgtatcccccaggtctcctcaacactgggctgatcctgaatggcacaggccaaggggaggccagcctcgcctttctacccaggccccctgccctgcccacctcaggcccccaccctccactcctccccacggtactgtgaacgtcgtgtgactcagtgcagagacagataatatatttaattcatgtac

SEQ ID NO: 123714 - DNA, 435 bp, Homo sapiens
  Payload ID: 4279
  Gene Symbol: CDK18
  Gene Name: cyclin-dependent kinase 18
  ENST ID: ENST00000506215
  CDS Start-End: 242-435
ccgtgcccgggagggagcgggcgcaccgcggcccccaggacacgcgcttgccccgcactgagaccattgaagaatccttggctgaattcacggagcaattcaaccagctccacaaccggcggaatgagaagaccccccgcaggagtgcagcaccttctccccaacagacagcggggaggagccggggcagctctcccctggcgtgcagttccagcggcggcagaaccagcgccgcttctccatggaggtaagggcctctggagctctgccccggcaggtggcaggatgcacgcacaagggtgtgcacaggagggcagctgccttacagccagactttgacgtcagcaagaggctctctctgcccatggatatccgcctgccccaggaattcctacagaagctacagatggagagcccagatctgcccaagccgct

SEQ ID NO: 123715 - DNA, 6067 bp, Homo sapiens
  Payload ID: 4280
  Gene Symbol: CDK19
  Gene Name: cyclin-dependent kinase 19
  Uniprot ID: Q9BWU1
  ENST ID: ENST00000323817
  CDS Start-End: 182-1510
agggggaggggcggccctggtacgcaggcgcgcatgctttgtgggggcgaggctgtggtggcccgagattccaggagggcttcgtgtatggacctcaagcgttggaggtagcagacttttcagcagaagaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 123716 - DNA, 6246 bp, Homo sapiens
  Payload ID: 4280
  Gene Symbol: CDK19
  Gene Name: cyclin-dependent kinase 19
  Uniprot ID: Q9BWU1
  ENST ID: ENST00000368911
  CDS Start-End: 181-1689
tgtggccgccgaggagtcccttgctgaaggcggaccgcggagcggcgggcggcgggcggcgcgcgcgcgcgcgcgagaggcggctgttggagaagtggagcggcggtcgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 123717 - DNA, 6007 bp, Homo sapiens
  Payload ID: 4280
  Gene Symbol: CDK19
  Gene Name: cyclin-dependent kinase 19
  ENST ID: ENST00000413605
  CDS Start-End: 254-1450
cgcggggggaggaggaggagggactgagcggcggcggcccccgcgtcccgtgcctctatgggggaagcagacaatggattatgatttcaaggcgaagctggcggcggagcgggagcgggtggaggatttgtttgagtacgaagggtgcaaagtgggacgcggcacctacggtcacgtctacaaggcgaggcggaaagatggaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccacagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccattgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttg

SEQ ID NO: 123718 - DNA, 955 bp, Homo sapiens
  Payload ID: 4280
  Gene Symbol: CDK19
  Gene Name: cyclin-dependent kinase 19
  ENST ID: ENST00000457688
  CDS Start-End: 203-955
agcgggtggaggatttgtttgagtacgaagggtgcaaagtgggacgcggcacctacggtcacgtctacaaggcgaggcggaaagatggattccaggagggcttcgtgtatggacctcaagcgttggaggtagcagacttttcagcagaagaaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttg

SEQ ID NO: 123719 - DNA, 604 bp, Homo sapiens
  Payload ID: 4280
  Gene Symbol: CDK19
  Gene Name: cyclin-dependent kinase 19
  ENST ID: ENST00000463016
  CDS Start-End: 1-367
aaaagatgaaaaggaatatgcattgaagcaaattgaaggcacaggaatatccatgtcggcttgtagagagattgcacttttgcgagaattgaagcaccctaatgtgattgcattgcagaaggtgttcctttctcacagtgacaggaaggtatggctgctgtttgattatgcagagcatgacttgtggcatattattaagtttcaccgtgcatcaaaagcaaataaaaagcccatgcagttgccaagatctatggttaaatccttactttaccagattcttgatggtatccattacctccatgcaaattgggtgcttcacagagacttgctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcag

SEQ ID NO: 123720 - DNA, 1260 bp, Homo sapiens
  Payload ID: 4281
  Gene Symbol: CDK2
  Gene Name: cyclin-dependent kinase 2
  Uniprot ID: P24941
  ENST ID: ENST00000354056
  CDS Start-End: 179-973
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaa

SEQ ID NO: 123721 - DNA, 2296 bp, Homo sapiens
  Payload ID: 4281
  Gene Symbol: CDK2
  Gene Name: cyclin-dependent kinase 2
  Uniprot ID: P24941
  ENST ID: ENST00000266970
  CDS Start-End: 241-1137
aacgcgggaagcaggggcggggcctctggtggcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgccaaggatccctgatcccattttcctctgacgtccacctcctaccccataggagttagaagttagggtttaggcatcattttgagaatgctgacactttttcagggctgtgattgagtgagggcatgggtaaaaatatttctttaaaagaaggatgaacaattatatttatatttcaggttatatccaatagtagagttggctttttttttttttttttggtcatagtgggtggatttgttgccatgtgcaccttggggttttgtaatgacagtgctaaaaaaaaaaagcattttttttttatgatttgtctctgtcacccttgtccttgagtgctcttgctattaacgttatttgtaatttagtttgtagctcattaaaaaaatgtgcctagttttata

SEQ ID NO: 123722 - DNA, 1031 bp, Homo sapiens
  Payload ID: 4281
  Gene Symbol: CDK2
  Gene Name: cyclin-dependent kinase 2
  ENST ID: ENST00000440311
  CDS Start-End: 180-896
attgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggcca

SEQ ID NO: 123723 - DNA, 2598 bp, Homo sapiens
  Payload ID: 4281
  Gene Symbol: CDK2
  Gene Name: cyclin-dependent kinase 2
  ENST ID: ENST00000555408
  CDS Start-End: 210-329
gcggtcgggaactcggtgggaggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaatagatccaatcagtttataccctagttagtgttttgcctcacctaataggctgggagactgaagactcagcccgggtggggctgcagaaaaatgattggccccagtccccttgtttgtcccttctacaggcatgaggaatctgggaggccctgagacagggattgtgcttcattccaatctattgcttcaccatggccttatgaggcaggtgagagatgtttgaatttttctcttccttttagtattcttagttgttcagttgc

SEQ ID NO: 123724 - DNA, 1367 bp, Homo sapiens
  Payload ID: 4281
  Gene Symbol: CDK2
  Gene Name: cyclin-dependent kinase 2
  ENST ID: ENST00000555357
  CDS Start-End: 179-298
ttgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacacgtgagtggcctctgtacccgggactcctaactggggacctccttgattgtcccccccaaccccccacgggcgggtagccgtccagggaccggaagagagcagggagggacttctttagaagtggagaggtgggttgggggccagtagaaggtgaagagtatacttatactccctggggagagtatagggtggtgtggaatccatggaaaactttcttcccaaactgagccggatcgtgcccccaaatgtgcgactacagactcggggagagaaaggaggtctctgagatgaggtccaagactctccatggagtggagttatgtgggaaccggcgagaatcgcctttctgaatgaagagccctcttcactgccccaccctcaccttagaattctctcctctttccaaagaatggcagttgaacctcactggcccctctggggaggctgggggctactcctgcattttttcccctccattacagtctccctgcttcaccttcaccaggcggctttacttacctacccctgggaaaagaggagataatggccttaatatatccaaaaaccacaccctgactacccaagaattagctcttaccatcaccctttctcttctctcactttcctagggggtgctgggtggtgtctccttgggggaaagaaatgactaggtgggggggaaaggaatatttgtaaccatattcccatctctgctttcccaacctctccaagtgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaaggtaatgcttctcatcagctcctctcatcatgggcatgtcttgggggactggtggcaggcaattcagggtgatattttatgattttggcctccttctgagccctcatctcctatacacacacactccccttctttttgtgtct

SEQ ID NO: 123725 - DNA, 1725 bp, Homo sapiens
  Payload ID: 4281
  Gene Symbol: CDK2
  Gene Name: cyclin-dependent kinase 2
  ENST ID: ENST00000553376
  CDS Start-End: 189-1229
ggcggcaacattgtttcaagttggccaaattgacaagagcgagaggtatactgcgttccatcccgacccggggccacggtactgggccctgtttccccctcctcggcccccgagagccagggtccgccttctgcagggttcccaggcccccgctccagggccgggctgacccgactcgctggcgcttcatggagaacttccaaaaggtggaaaagatcggagagggcacgtacggagttgtgtacaaagccagaaacaagttgacgggagaggtggtggcgcttaagaaaatccgcctggacactgagactgagggtgtgcccagtactgccatccgagagatctctctgcttaaggagcttaaccatcctaatattgtcaagctgctggatgtcattcacacagaaaataaactctacctggtttttgaatttctgcaccaagatctcaagaaattcatggatgcctctgctctcactggcattcctcttcccctcatcaagagctatctgttccagctgctccagggcctagctttctgccattctcatcgggtcctccaccgagaccttaaacctcagaatctgcttattaacacagagggggccatcaagctagcagactttggactagccagagcttttggagtccctgttcgtacttacacccatgaggtggtgaccctgtggtaccgagctcctgaaatcctcctgggctgcaaatattattccacagctgtggacatctggagcctgggctgcatctttgctgagatgcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctgatagccttcttgaagcccccagccctaatctcaccctctcctccagtgtgggcttgaccaggcttggccttgggctatttggactcaggtgggccctctgaacttgccttaaacactcaccttctagtcttggccagccaactctgggaatacaggggtgaaaggggggaaccagtgaaaatgaaaggaagtttcagtattagatgcacttaagttagcctccaccaccctttcccccttctcttagttattgctgaagagggttggtataaaaataattttaaaaaagccttcctacacgttagatttgccgtaccaatctctgaatgccccataattattatttccagtgtttgggatgaccaggatcccaagcctcctgctgccacaatgtttataaaggccaaatgatagcgggggctaagttggtgcttttgagaaccaagtaaaacaaaaccactgggaggagtctattttaaagaattcggttgaaaaaa

SEQ ID NO: 123726 - DNA, 1625 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000261692
  CDS Start-End: 523-870
gcccccaccatcaaggggaagaaagtgctcttcggattccggttcgccctggcctcccgcagccgccgcgggaccggcccccagcacacccccggggcgccgggcgcggggcagccgcccggacgcgcgcgggcctcaggcgccgccgggaccccagccccccaaactttggcaagttgcgggcgccgagcgcacccggaggcgcggggcgcggccgcaggcggagccgccccctgacgccgggccgccccctcccggccccggccgccccgccggctccgcggaaagtttgcggccgcccctgcgccgcacccggggcctgggtgagactgcggcggcggcagggcgcggacggccatatttgccggcgcggcccgagccgccgacaacaaaaagtgcgcgggcgctcggcgggcgctcggacgggcgcggggctgcagcgctaccgcccggcctcgccgccgccgccgccgccctcgcggcctggccccgccgcgcccggcgcgcccgccgcccggggggatgtcttacaaaccgaacttggccgcgcacatgcccgccgccgccctcaacgccgctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttcc

SEQ ID NO: 123727 - DNA, 931 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000544658
  CDS Start-End: 208-471
gtctcaaaggagtcttggatccccaaagggttaaaaaccacttcatacagacagagacatgaaatttatttgaaatcaatgtcaagcatcggttattctaatcctggggcttggccagacctgggcgtctggaatgatctacgtgcttaaatacaccactcgccaccattttctccagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctg

SEQ ID NO: 123728 - DNA, 1812 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000542174
  CDS Start-End: 825-1088
tcctagccacggactcccctgccagatccaggaggctgcgttctgggctgggccctgcttggtcactgactgcagctctggacaggccccaatgttgcatcccatatgtggggcctcaaccctcctgtcttgggatacagagcccttggggcatagactgctaagagtctggtcccctctttggggagggggagacaggcacagaggggttgaggggctttatctggggcacacagaggccatggtgttctctagatttctgatttgatgtccagcgtgcctgtctccagccagggttgggtctcaaatactccaaggccttcctgtcttccctgtcattgagcacagcagagatttgagcgcatagaagcaaaaaggcttggaagctcagcctggtttcgaccagcctatgtggcgctgtggtgtgatgtggcctctaggttctcagcctctggggaccaggacacagggagaggggatgggcagagttcaggccaggagtggcaataattttatctttgggagcagccctgctgcttggaaggttctggttggatgggatggagctctgtgaggaccagcggctgctgcagagctggggatggtcaggtgccttgtagctacatttcattatccatcttatatgctggtcaaaccggaggtggagagcagggttctccatcctgctacagttggtggtgtgggtcctgggcaagggctgttgcaggacccggagtccttgccttggtacaactggctgagctgactcctggcctctctctccccaccccacagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttatttt

SEQ ID NO: 123729 - DNA, 1161 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000538446
  CDS Start-End: 165-428
ctcttgggaagcactgcctctaacaaatggagaaactgaggactggagggcggggagcctgtctgaggtcacacagccaggagtggcacagctggggctggcacgaagtccagtggggaggacagaaaaggggagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 123730 - DNA, 1281 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000535979
  CDS Start-End: 285-548
cggggtcgtgaagcagcccgggcggggggcgctgcgggcagggccaggacccgcgcgggcgggcgcggatggagggctgcggggctgcggggctgcggggctgccgggctgccgggggccctgaggtcgcggggccgccgggactgggaccaggatggggtcgccggcgggcagcgtactcggaggcccgggggcctcggccgggagcgtgggagcaggggctaccccatgcggtcacgcggggacccccgtaagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaa

SEQ ID NO: 123731 - DNA, 344 bp, Homo sapiens
  Payload ID: 4282
  Gene Symbol: CDK2AP1
  Gene Name: cyclin-dependent kinase 2 associated protein 1
  ENST ID: ENST00000535796
  CDS Start-End: 146-344
cagcctggcaccagctgtctgtccccgaggccaagtctgcggcgcccactgtgtgtgtgagagagagaccgtgtggctctgggggcggcaggcgggcagctgccgaggaggactagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggta

SEQ ID NO: 123732 - DNA, 1144 bp, Homo sapiens
  Payload ID: 4282
  Gene Symbol: CDK2AP1
  Gene Name: cyclin-dependent kinase 2 associated protein 1
  Uniprot ID: O14519
  ENST ID: ENST00000618072
  CDS Start-End: 116-379
ccaagtctgcggcgcccactgtgtgtgtgagagagagaccgtgtggctctgggggcggcaggcgggcagctgccgaggaggactagctgggagtgtccactcgccttccaccagcatggcaacgtcttcacagtaccgccagctgctcagtgactacgggccaccgtccctaggctacacccagggaactgggaacagccaggtgccccaaagcaaatacgcggagctgctggccatcattgaagagctggggaaggagatcagacccacgtacgcagggagcaagagtgccatggagaggctgaagcgcggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattctt

SEQ ID NO: 123733 - DNA, 1378 bp, Homo sapiens
  Payload ID: 4283
  Gene Symbol: CDK2AP2
  Gene Name: cyclin-dependent kinase 2 associated protein 2
  Uniprot ID: O75956
  ENST ID: ENST00000301488
  CDS Start-End: 550-930
gcgcgcaaggcaccggtggcagcggcgacggcagctgcgacagcaacccctgctgggccgaaactgggcagagcggagcagacgtctgaagcagcgcgagtgaggcgcgagggtagcgcccgcgcccgggaagacccctcggcgcgaaccggcagcccagccccgggtcccggttcccaaggccccgcctctagggcctggggactaatcggattgagagcgcgccggcccgggccgcgaactcgccaattgcggagggcggtggccaccgcccaatccggagcagacaggtgcgaggtccggaaggcggaggccaatcggcggcggttgcgacctgctggggcaggtctcggccaataaggaggctcgagtgacatcttcgcgcaccaatcgggagtgagggagcattcgtgcccgctcgcccttccggccagacctctatttaccaggggcgtgcagcccgcttgccaatcagagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagcaggggcacaggcctggcacctccctgccttgtgtcctgagccatagtgactcttttatctgtgtgtcttttgctaaatatgccctttttatattaataaaagatgatttggagttgtgctctca

SEQ ID NO: 123734 - DNA, 634 bp, Homo sapiens
  Payload ID: 4283
  Gene Symbol: CDK2AP2
  Gene Name: cyclin-dependent kinase 2 associated protein 2
  ENST ID: ENST00000531506
  CDS Start-End: 10-330
gagttggggatgtcctacaaacccatcgcccctgctcccagcagcacccctggctccagcacccctgggccgggcaccccggtccctacaggaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtaagtgaggccaggccgccctgctcaggaaaccgacactggactatccttcatgagggaaggaaggacatctggaggccacctgagccaagcctagaggatgtccagtattactaccagagaggtgttttgaatcgaattgaaattgagtccatttccagggaagagcatgggaatttgtatttcaacagggcaaccttgaggattaaccaaacctctaatttcatctagccgtcattagatttgaatttcttttgccgaaagtggaaagggagtggggaggcaggggtcctcctctggagggcagtgggt

SEQ ID NO: 123735 - DNA, 923 bp, Homo sapiens
  Payload ID: 4283
  Gene Symbol: CDK2AP2
  Gene Name: cyclin-dependent kinase 2 associated protein 2
  ENST ID: ENST00000531178
  CDS Start-End: 77-262
agagcgcggctgagcggccccgcagccaacccccgaggagcggccggctggcgtccgccgcgcccaggagttggggatgtcctacaaacccatcgcccctgctcccagcagcacccctggctccagcacccctgggccgggcaccccggtccctacaggtgaggatccagctccacccctgctcgcctgccgggcggtcgaggtctcgaagagaagacggcctgagttctgcaatactgggcctgccgcctaccctcgctgagcctcagtttgctggcctgtgaagtgggcgtggtcacgaagcgtcccgtcgccgtcgggctcagtgccaggagccggcgctcctttcagaccgctgtttaacgactttggaccgccttccatgggctacgtgcaggcgatgaagccacccggcgcccagggctcccagagcacctacacggacctgctgtcagtcatagaggagatgggcaaagagatccggcctacctatgctggcagcaagagcgccatggagcgcctgaagagaggtatcatccatgcccgggccctagtcagagagtgcctggcagagacagagcggaacgcccgcacgtaacaggaagcgcctcggcctcagcgtctggacctatccggccactgcagagcacccgcttctccctggccttcatcccgagttgcactaaccatcctgggcttcctgtcctgtgtcccttggtgggtcccctccaggaaccaaggagtggccctccaggtggcagcactaaggacacccccccacaacaagagttagcagcgaggtccccatgagtcccacccatgacctgccgacagtgttgcccaccggaacttttgtggcccctaccgctcagcccttcccagcacttctcccactttgtcccgagcctccttctcccccagca

SEQ ID NO: 123736 - DNA, 955 bp, Homo sapiens
  Payload ID: 4284
  Gene Symbol: CINP
  Gene Name: cyclin-dependent kinase 2 interacting protein
  Uniprot ID: Q9BW66
  ENST ID: ENST00000216756
  CDS Start-End: 42-680
gcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttggggtcttctggccagagcttgtcaccagccccatggcctctccaggcgtgctcatgcccacaacccgcggccagccccacgtggtgctgctcagccttctctgcccctcctgggaatctgtcattcgtgggtgcttcagagtaaaatcaatgagtttctgagcagaa

SEQ ID NO: 123737 - DNA, 845 bp, Homo sapiens
  Payload ID: 4284
  Gene Symbol: CINP
  Gene Name: cyclin-dependent kinase 2 interacting protein
  Uniprot ID: Q9BW66
  ENST ID: ENST00000536961
  CDS Start-End: 90-773
agcctagcccgcaggcccctcgcagcctctgcgagctgctcgggagacagttttgccgagcctccgttttttcacatgtgcagtgacagatgaacgggacgatatacgcaaatgagtgtcagcagatccgacatccaaattcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtg

SEQ ID NO: 123738 - DNA, 572 bp, Homo sapiens
  Payload ID: 4284
  Gene Symbol: CINP
  Gene Name: cyclin-dependent kinase 2 interacting protein
  Uniprot ID: Q9BW66
  ENST ID: ENST00000541568
  CDS Start-End: 18-374
ggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccag

SEQ ID NO: 123739 - DNA, 549 bp, Homo sapiens
  Payload ID: 4284
  Gene Symbol: CINP
  Gene Name: cyclin-dependent kinase 2 interacting protein
  ENST ID: ENST00000558764
  CDS Start-End: 64-405
aaatgcgtttccggtggggtgggcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgagaatggtttccagacctggtctgtgtctttcataactttgaccttctgggggtttcatgcaccgttcttcctaagctgggctaacatttcactgtggtctgtgtttgctgtgggaagaagccaccgatgttgaaataccaaaatacaggtgaaaatggaaaagctgtcttcaactacca

SEQ ID NO: 123740 - DNA, 4270 bp, Homo sapiens
  Payload ID: 4284
  Gene Symbol: CINP
  Gene Name: cyclin-dependent kinase 2 interacting protein
  Uniprot ID: Q9BW66
  ENST ID: ENST00000559514
  CDS Start-End: 66-704
gcaaatgcgtttccggtggggtgggcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttggggtcttctggccagagcttgtcaccagccccatggcctctccaggcgtgctcatgcccacaacccgcggccagccccacgtggtgctgctcagccttctctgcccctcctgggaatctgtcattcgtgggtgcttcagagtaaaatcaatgagtttctgagcagaatgagatcccaggagggcactcatggtggtttatgggactctggactcctgagaagcggccttgagtctacaggatacatctacagcctgacctgaccacccaacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcaggaggccgaggcaggaggatcgcttaagcctgggagttaaaggctgcaatgagctatgattgcaccactgcactccagcctgggcaacagagtgaaaactcatctctaaaaaaaaaaatcaggccggggccgggcacagtggctcacgcctgtaatcccagcactttgggaggccgaggcaggcagatcacgaggtcaagagatcgagaccatcctggccaacatggtgaaacctcatctctactaaaaatacaaaaattagccgggtgtggtggcggacacctgtagtcccagctactcggcaggctgaggcaggagaatcacttgaacccaggaagcggagggtgcagtgagccgagattgcaccattgcacttcagcctggcgacagcaagactccatctcaaaaaaaaacaatcaggcccagtgcagtggctcacacctataatcccagcactttgggatgctgaggcgcgtagatcacctgaggtcaggagttcaagatcagcctgaccaccatggagataccccgtctctactaaaaatacaaaatgatccaggtgtgatggcacatgcctgtaatcccagctacttgggaggctgaggcaggagaattgcttgaaccctgtggtggaggttgcggtgagccaagatcgagccattgcactccagcttgggcaacaagaccaaaactccatctcaaaaaaaaaaaaaaaaatcattggccaggtgcagtggctcatgcctgtactgtaatcccagcactttgggaagctgaggtgggcggattgcctgagctcaagagtttgagaccaccctgggcaacatggtgaaaccccgtatctactaaaatacaaaaaaaaaaaattagctgggcatggtggcatgctcctgtagtcacagctactcaggaggctgaggcacgagaatcgcttgagcccaggcggcagaggttgcagtgagccaagatcgcgccactgcactccagcttgggctacagagtaagacttggtctcaaaaataattaaattaatttaatttaatttaatttaaaaaatcatgcaagtagaaatgactttttcccccttctatcaataaaatgctgcccagaatgactagcttattttctttttaattgaacccaaaagaagcttctagtatggagcaagtctggtggaaaagcagcatatctcccaggagagaagggaaacggagcagggccaatcatcaggtgacagtgcagtgctactcatcaccatcatgaaaaactcatgagcgtcagacgcgccacagggattcctgatcaggtaatatctgctattattatgacaagctccatagaaaaatgtagacagcagggcagaaagacattattctttataaataaaaggttcatctgtgcaatattcacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcctcctgagacactattgtacctggaggggacaagataagcccatcggaagtctgaataaaaatctgcttctgtccctgagacagtaactcatggctcccattggaaatttcaaaagccatggcttcgccgacagcaaccacgctctccagttctctctggccagagtgcacctccatcccacaggggaaccggttcaagtcccccgaaaggcttctgagacacccttcagtcaatagtgatccatgtgggccaggctgaggccctggcttgggcacagtcctgtaggcacagtccactgccacgctatccacagacaaaattttctcaagcggaggggctgccacctctgtaggcaggacgctggtggggctgggctgctggtggttcaggtggaagtcacaaaccttgccgaggtgtcctgcctctgcatgtccaggccccccaggcggcagggactctgctccaccaccagatgacaaagggctgcagaaacccgggctcctcaggctgtcccaggtgtcctggtctgaagagtgttccaaagcattctctccaggaaacgctgccacctgtgcctgggtcagcctcctaggctctcctgactgagcataaacaggcagcccactgacatcccgggatgagagagcagcacctatagaccccctcctggcttctaagttagccagtgcctgaagctgcgggcccgcctggaacacgctcccattgccaccagaaaccgtcgttgtatggctttcttcagaacggggagagacagtcacatttactggaggggaaaaacctaaacattttgggaaacaggtgaacatggcgtgtactgtgtcatggcccactcactgcactcaccacccaaaaccagctaggccaagtcacctgccctgcagaaaagtcaaagcatcgatgctccttgctccttgggattggtagcaattttaaaaaatacgtccctattctctattcacaaagacagattttgtattaaaaatatgctctaagagccaa

SEQ ID NO: 123741 - DNA, 1781 bp, Homo sapiens
  Payload ID: 4284
  Gene Symbol: CINP
  Gene Name: cyclin-dependent kinase 2 interacting protein
  ENST ID: ENST00000559504
  CDS Start-End: 1-640
cctatcagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttggggtcttctggccagagcttgtcaccagccccatggcctctccaggcgtgctcatgcccacaacccgcggccagccccacgtggtgctgctcagccttctctgcccctcctgggaatctgtcattcgtgggtgcttcagagtaaaatcaatgagtttctgagcagaatgagatcccaggagggcactcatggtggtttatgggactctggactcctgagaagcggccttgagtctacaggatacatctacagcctgacctgaccacccaacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcaggaggccgaggcaggaggatcgcttaagcctgggagttaaaggctgcaatgagctatgattgcaccactgcactccagcctgggcaacagaagtaagacttggtctcaaaaataattaaattaatttaatttaatttaatttaaaaaatcatgcaagtagaaatgactttttcccccttctatcaataaaatgctgccc

SEQ ID NO: 123742 - DNA, 2175 bp, Homo sapiens
  Payload ID: 4285
  Gene Symbol: CDK20
  Gene Name: cyclin-dependent kinase 20
  Uniprot ID: Q8IZL9
  ENST ID: ENST00000325303
  CDS Start-End: 307-1347
ctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtggtaccgagcccccgagctcctgtatggtgcccgccagtatgaccagggcgtcgatctgtggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatt

SEQ ID NO: 123743 - DNA, 2176 bp, Homo sapiens
  Payload ID: 4285
  Gene Symbol: CDK20
  Gene Name: cyclin-dependent kinase 20
  Uniprot ID: Q8IZL9
  ENST ID: ENST00000336654
  CDS Start-End: 144-1160
gtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagccgagggtgggctggcagtgtctgccttctatcctgcagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 123744 - DNA, 1907 bp, Homo sapiens
  Payload ID: 4285
  Gene Symbol: CDK20
  Gene Name: cyclin-dependent kinase 20
  Uniprot ID: Q8IZL9
  ENST ID: ENST00000375871
  CDS Start-End: 42-773
agttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaa

SEQ ID NO: 123745 - DNA, 2301 bp, Homo sapiens
  Payload ID: 4285
  Gene Symbol: CDK20
  Gene Name: cyclin-dependent kinase 20
  Uniprot ID: Q8IZL9
  ENST ID: ENST00000375883
  CDS Start-End: 308-1285
gctgtcatcgttccgtgggccctgctgcgggcacgctctcggcgcatgcgttttttatgcgggattaagcttgctgctgcgtgacagcggagggctaggaaaaggcgcagtggggcccggagctgtcacccctgactcgacgcagcttccgttctcctggtgacgtcgcctacaggaaccgccccagtggtcagctgccgcgctgttgctaggcaacagcgtgcgagctcagatcagcgtggggtggaggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaaggctctcctccatcagtacttcttcacagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatcccagctagtgctttttccttattataatttgataaggtgattataaaagatacatggaaggaagtggaaccagatgcagaagaggaaatgatggaaggacttacggtatcagataccaatatttaaaagtttgtataataataaagagtatgattgtggttcaaggat

SEQ ID NO: 123746 - DNA, 1860 bp, Homo sapiens
  Payload ID: 4285
  Gene Symbol: CDK20
  Gene Name: cyclin-dependent kinase 20
  Uniprot ID: Q8IZL9
  ENST ID: ENST00000605159
  CDS Start-End: 60-887
ggagaagtggagtttggaagttcaggggcacaggggcacaggcccacgactgcagcgggatggaccagtactgcatcctgggccgcatcggggagggcgcccacggcatcgtcttcaaggccaagcacgtggagactggcgagatagttgccctcaagaaggtggccctaaggcggttggaggacggcttccctaaccaggccctgcgggagattaaggctctgcaggagatggaggacaatcagtatgtggtacaactgaaggctgtgttcccacacggtggaggctttgtgctggcctttgagttcatgctgtcggatctggccgaggtggtgcgccatgcccagaggccactagcccaggcacaggtcaagagctacctgcagatgctgctcaagggtgtcgccttctgccatgccaacaacattgtacatcgggacctgaaacctgccaacctgctcatcagcgcctcaggccagctcaagatagcggactttggcctggctcgagtcttttccccagacggcagccgcctctacacacaccaggtggccaccaggtctgtgggctgcatcatgggggagctgttgaatgggtccccccttttcccgggcaagaacgatattgaacagctttgctatgtgcttcgcatcttgggcaccccaaaccctcaagtctggccggagctcactgagctgccggactacaacaagatctcctttaaggagcaggtgcccatgcccctggaggaggtgctgcctgacgtctctccccaggcattggatctgctgggtcaattccttctctaccctcctcaccagcgcatcgcagcttccaagctcccctgcctgcccatccatctgagctgccgattcctcagcgtctagggggacctgcccccaaggcccatccagggcccccccacatccatgacttccacgtggaccggcctcttgaggagtcgctgttgaacccagagctgattcggcccttcatcctggaggggtgagaagttggccctggtcccgtctgcctgctcctcaggaccactcagtccacctgttcctctgccacctgcctggcttcaccctccaaggcctccccatggccacagtgggcccacaccacaccctgccccttagcccttgcgagggttggtctcgaggcagaggtcatgttcccagccaagagtatgagaacatccagtcgagcagaggagattcatggcctgtgctcggtgagccttaccttctgtgtgctactgacgtacccatcaggacagtgagctctgctgccagtcaaggcctgcatatgcagaatgacgatgcctgccttggtgctgcttccccgagtgctgcctcctggtcaaggagaagtgcagagagtaaggtgtccttatgttggaaactcaagtggaaggaagatttggtttggttttattctcagagccattaaacactagttcagtatgtgagatatagattctaaaaacctcaggtggctctgccttatgtctgttcctccttcatttctctcaagggaaatggctaaggtggcattgtctcatggctctcgtttttggggtcatggggagggtagcaccaggcatagccacttttgccctgagggactcctgtgtacttcacatcactgagcactcatttagaagtgagggagacagaagtctaggcccagggatggctccagttggggatccagcaggagaccctctgcacatgaggctggtttaccaacatctactccctcaggatgagcgtgagccagaagcagctgtgtatttaaggaaacaagcgttcctggaattaatttataaatttaataaatcccaatataatccca

SEQ ID NO: 123747 - DNA, 1582 bp, Homo sapiens
  Payload ID: 4286
  Gene Symbol: CDK3
  Gene Name: cyclin-dependent kinase 3
  Uniprot ID: Q00526
  ENST ID: ENST00000425876
  CDS Start-End: 89-1006
ccacatggaagctggaggagcaacgggagcgctgggcgtggggtgcaaattgcccggtgccttctgtttcccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaataaataaacgtggtatgttcctgag

SEQ ID NO: 123748 - DNA, 803 bp, Homo sapiens
  Payload ID: 4286
  Gene Symbol: CDK3
  Gene Name: cyclin-dependent kinase 3
  ENST ID: ENST00000586261
  CDS Start-End: 164-803
ctgactgtggagtttggtggatgacgtgccaaggagcacaggtctccattgccggggccctggtcattctgtggggttaaggagaagccgatccccctggctggaagtgcccttcttggcccaagtctctgcccacggctgtgcccttgtttcttgcagggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgccca

SEQ ID NO: 123749 - DNA, 570 bp, Homo sapiens
  Payload ID: 4286
  Gene Symbol: CDK3
  Gene Name: cyclin-dependent kinase 3
  ENST ID: ENST00000588812
  CDS Start-End: 77-570
gcccttcctggccgccatgtgtacccagagcctgggactggctgggctgggcagtgacccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgac

SEQ ID NO: 123750 - DNA, 2076 bp, Homo sapiens
  Payload ID: 4287
  Gene Symbol: CDK4
  Gene Name: cyclin-dependent kinase 4
  Uniprot ID: P11802
  ENST ID: ENST00000257904
  CDS Start-End: 367-1278
gtgatagcaacagatcacgtggctgccatcgcccctccgcccccttacactcttcgccctcctcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtcttttttttttttttaatgtttcttcctctgtttggctttgccattgtgcgatttggaaaaaccacttggaagaagggactttcctgcaaaaccttaaagactggttaaattacagggcctaggaagtcagtggagccccttgactgacaaagcttagaaaggaactgaaattgcttctttgaatatggattttaggcggggcgtggtggctcacgcctataatcccagcacgttgggaggccaacgcgggtggatcacctgaggtcaggagttcgagaccagcctgactaacatggtgaaaccctgtctctactaaaaatacaaaattagtcaggcgtggtggtgcacacctgtaatcccagctacttgggagactgaggcaggaggatcgcttgaacccgggaggcagaggttgcggtgagccgagatcatgccattgcactccagcctgggcaacagagcaagactctgtgtcaaaaaaaaaaaaagaatatagatttttaaatggc

SEQ ID NO: 123751 - DNA, 1650 bp, Homo sapiens
  Payload ID: 4287
  Gene Symbol: CDK4
  Gene Name: cyclin-dependent kinase 4
  ENST ID: ENST00000312990
  CDS Start-End: 293-628
cacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtcttttttttttttttaatgtttcttcctctgtttggctttgccattgtgcgatttggaaaaaccacttggaagaagggactttcctgcaaaaccttaaagactggttaaattacagggcctaggaagtcagtggagccccttgactgacaaagcttagaaaggaactgaaattgcttctttgaatatggattttaggcggggcgtggtggctcacgcctataatcccagcacgttgggaggccaacgcgggtggatcacctgaggtcaggagttcgagaccagcctgactaacatggtgaaaccctgtctctactaaaaatacaaaattagtcaggcgtggtggtgcacacctgtaatcccagctacttgggagactgaggcaggaggatcgcttgaacccgggaggcagaggttgcggtgagccgagatcatgccattgcactccagcctgggcaacagagcaagactctgtgtcaaaaaaaaaaaaagaatatagatttttaaatggc

SEQ ID NO: 123752 - DNA, 447 bp, Homo sapiens
  Payload ID: 4287
  Gene Symbol: CDK4
  Gene Name: cyclin-dependent kinase 4
  ENST ID: ENST00000552862
  CDS Start-End: 102-447
accccattcccactccgtgtcctggggcccgcccagcctccttaggcgccgcgcctgctcgcggtctccgctgacaccccagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaa

SEQ ID NO: 123753 - DNA, 558 bp, Homo sapiens
  Payload ID: 4287
  Gene Symbol: CDK4
  Gene Name: cyclin-dependent kinase 4
  ENST ID: ENST00000549606
  CDS Start-End: 337-459
gcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtc

SEQ ID NO: 123754 - DNA, 825 bp, Homo sapiens
  Payload ID: 4287
  Gene Symbol: CDK4
  Gene Name: cyclin-dependent kinase 4
  ENST ID: ENST00000547281
  CDS Start-End: 267-825
cgtccagctgctccggaccgagctcgggtgtatggggccgtaggaaccggctccggggccccgataacgggccgcccccacagcaccccgggctggcgtgagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtgg

SEQ ID NO: 123755 - DNA, 776 bp, Homo sapiens
  Payload ID: 4287
  Gene Symbol: CDK4
  Gene Name: cyclin-dependent kinase 4
  ENST ID: ENST00000546489
  CDS Start-End: 153-776
gggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaag

SEQ ID NO: 123756 - DNA, 919 bp, Homo sapiens
  Payload ID: 4287
  Gene Symbol: CDK4
  Gene Name: cyclin-dependent kinase 4
  ENST ID: ENST00000550419
  CDS Start-End: 141-746
tctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtgaccagggcttgctgtgttgcccaggctggattgcaatggcatgatcacagctcactgcagcttcaacctcctgggctcaagtgatcctcccatctcagcttcccaactagctgacactacaggcctctcttctgtggaaactctgaagccgaccagttgggcaaaatctttgacctgattgggctgcctccagaggatgactggcctcgagatgtatccctgccccgtggagcctttccccccagagggccccgccc

SEQ ID NO: 123757 - DNA, 952 bp, Homo sapiens
  Payload ID: 4287
  Gene Symbol: CDK4
  Gene Name: cyclin-dependent kinase 4
  ENST ID: ENST00000553237
  CDS Start-End: 172-396
gtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaat

SEQ ID NO: 123758 - DNA, 694 bp, Homo sapiens
  Payload ID: 4287
  Gene Symbol: CDK4
  Gene Name: cyclin-dependent kinase 4
  ENST ID: ENST00000552388
  CDS Start-End: 184-694
gggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcac

SEQ ID NO: 123759 - DNA, 769 bp, Homo sapiens
  Payload ID: 4287
  Gene Symbol: CDK4
  Gene Name: cyclin-dependent kinase 4
  ENST ID: ENST00000552254
  CDS Start-End: 161-769
gccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatc

SEQ ID NO: 123760 - DNA, 773 bp, Homo sapiens
  Payload ID: 4287
  Gene Symbol: CDK4
  Gene Name: cyclin-dependent kinase 4
  ENST ID: ENST00000551800
  CDS Start-End: 377-773
ctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagaga

SEQ ID NO: 123761 - DNA, 228 bp, Homo sapiens
  Payload ID: 4287
  Gene Symbol: CDK4
  Gene Name: cyclin-dependent kinase 4
  ENST ID: ENST00000547853
  CDS Start-End: 223-228
cgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggagggggtctcccttgatctgagaatggct

SEQ ID NO: 123762 - DNA, 783 bp, Homo sapiens
  Payload ID: 4288
  Gene Symbol: CDK5
  Gene Name: cyclin-dependent kinase 5
  Uniprot ID: Q00535
  ENST ID: ENST00000297518
  CDS Start-End: 1-783
atgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctag

SEQ ID NO: 123763 - DNA, 1758 bp, Homo sapiens
  Payload ID: 4288
  Gene Symbol: CDK5
  Gene Name: cyclin-dependent kinase 5
  Uniprot ID: Q00535
  ENST ID: ENST00000485972
  CDS Start-End: 683-1561
actaaaatccagcctcgaaggggcacagctgttctcccagccctgcggtcagctgttccctgtgaggtcatcatcgctcacaggcattccccagtcaattctggggtcactaggtggcttggggagaggtggaaacccgtgctgaggtcgtcaagaggccgttgggaacacaatgccaccaaccaggtcagcgctgggccgccagtgcccgggatctaggccgccaaaccccaaacccctaaccgagagcgctccgcccccatttccgctgcattctggaacgcgtagtcccggagcggcccttttcaagagggctgggagcacataaaaggaataacaacagcggggcacactgggaaccacggcgccgcggcggggcgcccggaaaacggacacgcgttgcttcctgggacttgaagtccaaggtttgcctccgcggtagaaacggagccctggagtcgagtgctgcagagagcgtgagcgcagacggctgggggttgtagtcttcttgtcctcggtctcgggcattgcggggagacctagtcgttttaggactacaagccccagaaggccctgcgcgggcagacggggcggggctggaggctcaggtgccgcctcctctgcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacagtc

SEQ ID NO: 123764 - DNA, 4325 bp, Homo sapiens
  Payload ID: 4289
  Gene Symbol: CDK5R1
  Gene Name: cyclin-dependent kinase 5, regulatory subunit 1 (p35)
  Uniprot ID: Q15078
  ENST ID: ENST00000313401
  CDS Start-End: 690-1613
ggctgctgttgggcggcggcgcggagcgggcggcgagctgtgcgggaggggcggccccgaggggcggggcgggccgacgccgcgtgtcccgccgcagccgcggagtccggctcctagatggggcccggcgcgtagaggtgcctcccgctcgttgccgcgtcctacccgcaccgtgcgcggctcgagctgaggacaccaacggccgcgactccccggcgagaccaggccggagcgtggacggcgcgcgcgccccgcgagggagggcgctgaggcgcgcgccggaagcgggagcgggagcgggagcgcggcggcggcggcgaaggtgcgggcggccgagcggggggcggggctgcggtgcctgcagaaccttggacagaagctccctagctgccgccgccgccgccgccgccgtcgccgccgccgagcgcgagcccagccgatccccgccgagcgcccccgagcgccgccgagcgccgggaccgcggcggcggggccgcggcgcgcattgcggagggcgcggagcgcaggagctgccgcctgccgggcagatccaagggggcagcacgcttcccgggagcgcccccgcctcctctccggggccgccgcaggctcggtgagcggttttatccctccggccggcaggctgggcgcgcaggggcgcgagcccccgcccggcgcgcagcagcaccatgggcacggtgctgtccctgtctcccagctaccggaaggccacgctgtttgaggatggcgcggccaccgtgggccactatacggccgtacagaacagcaagaacgccaaggacaagaacctgaagcgccactccatcatctccgtgctgccttggaagagaatcgtggccgtgtcggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctgggtgagtttctctgccgccggtgctaccgcctgaagcacctgtcccccacggaccccgtgctctggctgcgcagcgtggaccgctcgctgcttctgcagggctggcaggaccagggcttcatcacgccggccaacgtggtcttcctctacatgctctgcagggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtacagtatgtgtctagcaaagccaccaagggcctcacctttcccacagtctctccctggggtttttttcatccctgccaagaactctgggcacttttgaactcacgagccttgcgcaaaacccagaagatgtattcagagccacccaggccactgacctcccactttggggaactcaaaggactgacctgcccctgccgcctgtgcccttgctgggtccagggtaggcaaggctgccggctgcaccctgtatggagctagagaggggcctctggctgcctggcccagggaggaattggggtttctggttggaggcccttttctggctcctgtgtggagttattcactctcccagaggctcctggagccagccaccctaactgagctgccagtggggtcgtgaggcaagatccccgccacccggggacatcttcaatctaggcgaggcgaagctgagcgggtctagtggaaagattgtgtctggtcgtttgaccacacaccgccctgatttgctgttttctttttttagggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtgaccccacccccacccgttaatttaaagctgtttctaaacagttgagtttcttctaaagaggaagccttgcccagcaaggaccagtgagacagccggatcttggagacaattacaagacggggagtgagactcctgattgctctggaagcctgctgatttctacaactgatcatttgcagctgctggttttggtttccaccttaccctactggctgtaaaaacacaaatgtgtactttattgattttctttctaattctcccgcattggtggcttgggacttgggagagggagcaagccttcctccatggcccatcactcggctgtggagaacaaagaccaatgtgaagacactacagaggattctgtcttccaggcccagtccactggggagtgctggaatggggacctggggtggggaggcagagggtcactttacataggattaagttcgaggtggctaccgatttcagcacatgcactactgaaatttacacaaaaagaaagctgtgaaattgaagtcccaatttaagagtcctgaggcagaacctggtggctggaggcattcccagaggtggggaagagagcctgcccggccggagaacatctgccttgctgcacctgaggcccagcagagccgttcctgggactgtcagataatcggtgcagcggtggaaggagcctgcggctgctggcacagacttcacacagcacctcctctctgctgggtttccacacagcctgtcttcagatcctgctgccgcgtgcgaccagaggtgggaggcccctggtggcatggaagagggagggtcagtgccaagtctcaggaggagggcgcatgtgtgtatcaccctcagctggcggaacctggctgcgaactgtgcagttacgttgcatccacaggattccagttgcgtgtctgtttccttctctttctccgtatttatttttttattcttcggaggaggtggacatttcggaagtggtggggactaagggaagaactctctagttccctcagtgtgaagcctgtcgtgttctctccccttgcactggtcatcagtattgtgtaaaggaacaactgatatacttgagtgtgcaagcaaagaacccatttgccatgctgctatgaagactacttttagatcaacaataaaaaaaaacctacaaaaaaacctttattctttaattgttgcttttacggtgatattgtgcatgcaaaccaggagcattttgtgtcttaagaaaaataatcttagaacagatggctgtgaaaattacacccatgcacagaacaagccacaggaataatagttcaggatttggtttttctctttttcttgtaaacctggagggttgatatattctttccatgcagttattagaacttagttttgttccaacagttaaacttgcaatgaaaagaaaatgtgccatttttttcactcagaattattcatagctgtatatttgaaactgctaattacacacgtgtgatgtatgttggttttttagtgcaatttcttctgtagctattctttgaccaaactgtgggtattgttaatattaatttatatttgtctcattttgtatgtatgtgtagtgtgtttgtgagtatgtgtggtttataatctgacaaagtcatgaagctcagtttggctgtaatttaattccccttcccttatttttatttatttttgtactgtgctgattcaataaaatgcactgaccatccatta

SEQ ID NO: 123765 - DNA, 962 bp, Homo sapiens
  Payload ID: 4289
  Gene Symbol: CDK5R1
  Gene Name: cyclin-dependent kinase 5, regulatory subunit 1 (p35)
  ENST ID: ENST00000584716
  CDS Start-End: 1-347
cggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctggggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcgggagaagggcttttctttagtggagaaatggaactcgcccccctacccccttgtctgctgctcccagccacgttggtggtattggccgatgagctggtttgactcattaatttctctcaatttgggtcccagctaaagaggtggggtgaagctggggacagctttcctgggtgagtttttcttttgaataatgtagtgcagtcaccctgtggcaaatgccaggacagctgcaggtgcccattagcaacgcctgccttctgggcaaggtgagggatgccataccttgagaccaagccggtgcccacctaagggctaaggcctcttgctggtgcacatgacatttgtcctgcagagctggggggaaggcgatgtggtga

SEQ ID NO: 123766 - DNA, 664 bp, Homo sapiens
  Payload ID: 4289
  Gene Symbol: CDK5R1
  Gene Name: cyclin-dependent kinase 5, regulatory subunit 1 (p35)
  ENST ID: ENST00000584792
  CDS Start-End: 1-347
cggccaagaagaagaactccaagaaggtgcagcccaacagcagctaccagaacaacatcacgcacctcaacaatgagaacctgaagaagtcgctgtcgtgcgccaacctgtccacattcgcccagcccccaccggcccagccgcctgcacccccggccagccagctctcgggttcccagaccgggggctcctcctcagtcaagaaagcccctcaccctgccgtcacctccgcagggacgcccaaacgggtcatcgtccaggcgtccaccagtgagctgcttcgctgcctggggatgttatctcctccgaggtgggctcggatcacgagctccaggccgtcctgctgacatgcctgtacctctcctactcctacatgggcaacgagatctcctacccgctcaagcccttcctggtggagagctgcaaggaggccttttgggaccgttgcctctctgtcatcaacctcatgagctcaaagatgctgcagataaatgccgacccacactacttcacacaggtcttctccgacctgaagaacgagagcggccaggaggacaagaagcggctcctcctaggcctggatcggtgagcactgtagcctgcgtcatggctcaaggattcaatgcatttttaagaatttattattaaatcagttttgtgtaca

SEQ ID NO: 123767 - DNA, 2508 bp, Homo sapiens
  Payload ID: 4290
  Gene Symbol: CDK5R2
  Gene Name: cyclin-dependent kinase 5, regulatory subunit 2 (p39)
  Uniprot ID: Q13319
  ENST ID: ENST00000302625
  CDS Start-End: 167-1270
agctcaggattagagcagcggagccgcctagcagccaccttcccccgccagtccgcgcgcccgggccggggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgcagatggtt

SEQ ID NO: 123768 - DNA, 11612 bp, Homo sapiens
  Payload ID: 4291
  Gene Symbol: CDK6
  Gene Name: cyclin-dependent kinase 6
  Uniprot ID: Q00534
  ENST ID: ENST00000265734
  CDS Start-End: 413-1393
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgatttttctaaccttgaatgctgccagtgtggagtgggtaatccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttggcaaagtatccatcttgtctatctcccggcacttctgaaatatattgctaccattgtataactaataacagattgcttaagctgttcccatgcaccacctgtttgcttgctttcaatgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgcttttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaagagaaaaagagaaacttgtccatttagctttcataagaaatcccatggcaaagggtaataaaaaggacctaatcttaaaaatacaatttctaagcacttgtaagaacccagtgggttggagcctcccactttgtccctcctttgaagtggatgggaactcaaggtgcaaagaacctgttttggaagaaagcttggggccatttcagccccctgtattctcatgattttctctcaggaagcacacactgtgaatggcagacttttcatttagccccaggtgacttactaaaaatagttgaaaattattcacctaagaatagaatctcagcattgtgttaaataaaaatgaaagctttagaaggcatgagatgttcctatcttaaataaagcatgtttcttttctatagagaaatgtatagtttgactctccagaatgtactatccatcttgatgagaaaactcttaaatagtaccaaacattttgaactttaaattatgtatttaaagtgagtgtttaagaaactgtagctgcttcttttacaagtggtgcctattaaagtcagtaatggccattattgttccattgtggaaattaaattatgtaagcttcctaatatcataaacatattaaaattcttctaaaatattgcttttcttttaagtgacaatttgactattcttatgataagcacatgagagtgtcttacattttccaaaagcaggctttaattgcatagttgagtctaggaaaaaataatgttaaaagtgaatatgccaccataattacttaattatgttagtatagaaactacagaatatttaccctggaaagaaaatattggaatgttattataaactcttagatatttatataattcaaaagaatgcatgtttcacattgtgacagataaagatgtatgatttctaaggctttaaaaattattcataaaacagtgggcaatagataaaggaaattctggagaaaatgaaggtatttaaagggtagtttcaaagctatatatattttgaaggatatattctttatgaacaaatatattgtaaaaatttatactaaggtcatctggtaactgtgggattaatatggtcgaaaacaaatgttatggagaagctgtcccaagcaaactaaattacctgtacttttttcccatttcaagggaagaggcaaccacatgaagcaatacttcttacacatgcctaagaacgttcattgaaaaaataaatttttaaaaggcatgtgtttcctatgccaccaatacttttgaaaaattgtgaaccttacccaaaaccatttatcatgtccattaagtatatttgggtatataattaggaagatatttacatgttccatctccacagtggaaaaacttattgaggctaccaaagtgtgccaagaaatgtaagtccttagagtaattagaaatgctgttttcctcaaaagcatgagaaactagcattttcatttcttatttactccctttctatatcaatgcaattcacaacccaattttaatacatccctatatctcaagcatttctatcttgtactttttcagaaaataaaccaaaaataatcctttggtctctctatcttctgacctttgtaagcaacagaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagttttttggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactgaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacatgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcacgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcagaa

SEQ ID NO: 123769 - DNA, 1465 bp, Homo sapiens
  Payload ID: 4291
  Gene Symbol: CDK6
  Gene Name: cyclin-dependent kinase 6
  Uniprot ID: Q00534
  ENST ID: ENST00000424848
  CDS Start-End: 485-1465
gctggtaactccttccccagagtctgattacctgctccgcgaggccgcggacacgtgcggagagccgactgacactcgcagccccctcgggaggcccgacgcgactgggcccctcaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctga

SEQ ID NO: 123770 - DNA, 1439 bp, Homo sapiens
  Payload ID: 4292
  Gene Symbol: CDK7
  Gene Name: cyclin-dependent kinase 7
  Uniprot ID: P50613
  ENST ID: ENST00000256443
  CDS Start-End: 104-1144
cccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaagatctga

SEQ ID NO: 123771 - DNA, 531 bp, Homo sapiens
  Payload ID: 4292
  Gene Symbol: CDK7
  Gene Name: cyclin-dependent kinase 7
  ENST ID: ENST00000508726
  CDS Start-End: 8-217
gcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaat

SEQ ID NO: 123772 - DNA, 722 bp, Homo sapiens
  Payload ID: 4292
  Gene Symbol: CDK7
  Gene Name: cyclin-dependent kinase 7
  ENST ID: ENST00000504147
  CDS Start-End: 19-195
cgggctttacggcgccggatggctctggacgtgaagtctcgggcaaagcgttatgagaagctggacttccttggggagggacagtttgccaccgtttacaaggccagagataagaacaccaaccaaattgtcgccattaagaaagagtctctgctggtagccactacagctgtgaatgtgctgtgtcatacctgaagccaatatgtctcggagtttcacctgaggcccatgatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagtt

SEQ ID NO: 123773 - DNA, 1455 bp, Homo sapiens
  Payload ID: 4292
  Gene Symbol: CDK7
  Gene Name: cyclin-dependent kinase 7
  ENST ID: ENST00000502604
  CDS Start-End: 491-1252
gtggaggccagaggtctggcttggctgctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcaggaactctgggctctttgcttcgcgaaatgtaaaaatgcaaaaaggcaaacacaaaaactcccataaacttatgttatttctatttttctttctagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaa

SEQ ID NO: 123774 - DNA, 1164 bp, Homo sapiens
  Payload ID: 4292
  Gene Symbol: CDK7
  Gene Name: cyclin-dependent kinase 7
  ENST ID: ENST00000514676
  CDS Start-End: 65-994
ctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaa

SEQ ID NO: 123775 - DNA, 728 bp, Homo sapiens
  Payload ID: 4292
  Gene Symbol: CDK7
  Gene Name: cyclin-dependent kinase 7
  ENST ID: ENST00000506563
  CDS Start-End: 281-728
ggaagtgaggcggggatactaaagcgacggagcccggtggacggaagtgggtgttggaggctttaagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtc

SEQ ID NO: 123776 - DNA, 809 bp, Homo sapiens
  Payload ID: 4292
  Gene Symbol: CDK7
  Gene Name: cyclin-dependent kinase 7
  ENST ID: ENST00000515391
  CDS Start-End: 98-331
ggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattgctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccg

SEQ ID NO: 123777 - DNA, 477 bp, Homo sapiens
  Payload ID: 4292
  Gene Symbol: CDK7
  Gene Name: cyclin-dependent kinase 7
  ENST ID: ENST00000506789
  CDS Start-End: 85-261
tgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtg

SEQ ID NO: 123778 - DNA, 486 bp, Homo sapiens
  Payload ID: 4292
  Gene Symbol: CDK7
  Gene Name: cyclin-dependent kinase 7
  ENST ID: ENST00000515180
  CDS Start-End: 90-257
gtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatgctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagat

SEQ ID NO: 123779 - DNA, 818 bp, Homo sapiens
  Payload ID: 4292
  Gene Symbol: CDK7
  Gene Name: cyclin-dependent kinase 7
  ENST ID: ENST00000510106
  CDS Start-End: 79-210
aggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaagtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcat

SEQ ID NO: 123780 - DNA, 477 bp, Homo sapiens; identical to SEQ ID NO: 123777
  Payload ID: 4292
  Gene Symbol: CDK7
  Gene Name: cyclin-dependent kinase 7
  ENST ID: ENST00000617941
  CDS Start-End: 85-261

SEQ ID NO: 123781 - DNA, 809 bp, Homo sapiens; identical to SEQ ID NO: 123776
  Payload ID: 4292
  Gene Symbol: CDK7
  Gene Name: cyclin-dependent kinase 7
  ENST ID: ENST00000617289
  CDS Start-End: 98-331

SEQ ID NO: 123782 - DNA, 728 bp, Homo sapiens
  Payload ID: 4292
  Gene Symbol: CDK7
  Gene Name: cyclin-dependent kinase 7
  ENST ID: ENST00000613505
  CDS Start-End: 281-728
ggaagtgaggcggggatactaaagcgacggagcccagtggacggaagtgggtgttggaggctttaagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtc

SEQ ID NO: 123783 - DNA, 531 bp, Homo sapiens; identical to SEQ ID NO: 123771
  Payload ID: 4292
  Gene Symbol: CDK7
  Gene Name: cyclin-dependent kinase 7
  ENST ID: ENST00000618909
  CDS Start-End: 8-217

SEQ ID NO: 123784 - DNA, 1455 bp, Homo sapiens
  Payload ID: 4292
  Gene Symbol: CDK7
  Gene Name: cyclin-dependent kinase 7
  ENST ID: ENST00000614858
  CDS Start-End: 491-1252
gtggaggccagaggtctggcttggctgctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcagaaactctgggctctttgcttcgcgaaatgtaaaaatgcaaaaaggcaaacacaaaaactcccataaacttatgttatttctatttttctttctagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaa

SEQ ID NO: 123785 - DNA, 486 bp, Homo sapiens; identical to SEQ ID NO: 123778
  Payload ID: 4292
  Gene Symbol: CDK7
  Gene Name: cyclin-dependent kinase 7
  ENST ID: ENST00000614881
  CDS Start-End: 90-257

SEQ ID NO: 123786 - DNA, 1432 bp, Homo sapiens
  Payload ID: 4292
  Gene Symbol: CDK7
  Gene Name: cyclin-dependent kinase 7
  Uniprot ID: P50613
  ENST ID: ENST00000615305
  CDS Start-End: 104-1144
cccagtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtctccttgatgcttttggacataaatctaatattagccttgtctttgattttatggaaactgatctagaggttataataaaggataatagtcttgtgctgacaccatcacacatcaaagcctacatgttgatgactcttcaaggattagaatatttacatcaacattggatcctacatagggatctgaaaccaaacaacttgttgctagatgaaaatggagttctaaaactggcagattttggcctggccaaatcttttgggagccccaatagagcttatacacatcaggttgtaaccaggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaa

SEQ ID NO: 123787 - DNA, 818 bp, Homo sapiens; identical to SEQ ID NO: 123779
  Payload ID: 4292
  Gene Symbol: CDK7
  Gene Name: cyclin-dependent kinase 7
  ENST ID: ENST00000615854
  CDS Start-End: 79-210

SEQ ID NO: 123788 - DNA, 722 bp, Homo sapiens; identical to SEQ ID NO: 123772
  Payload ID: 4292
  Gene Symbol: CDK7
  Gene Name: cyclin-dependent kinase 7
  ENST ID: ENST00000622424
  CDS Start-End: 19-195

SEQ ID NO: 123789 - DNA, 1164 bp, Homo sapiens; identical to SEQ ID NO: 123774
  Payload ID: 4292
  Gene Symbol: CDK7
  Gene Name: cyclin-dependent kinase 7
  ENST ID: ENST00000617026
  CDS Start-End: 65-994

SEQ ID NO: 123790 - DNA, 358 bp, Homo sapiens
  Payload ID: 4292
  Gene Symbol: CDK7
  Gene Name: cyclin-dependent kinase 7
  ENST ID: ENST00000628367
  CDS Start-End: 182-358
ggaacgccaaccgcctgggcctagcgcagcttcctccgcccaccacggaagtgaggcggggatactaaagcgacggagcccagtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaagagtctctgctggtagccactacagctgtgaatgtgctgtgtcatacctga

SEQ ID NO: 123791 - DNA, 358 bp, Homo sapiens
  Payload ID: 4292
  Gene Symbol: CDK7
  Gene Name: cyclin-dependent kinase 7
  ENST ID: ENST00000626796
  CDS Start-End: 182-358
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaagagtctctgctggtagccactacagctgtgaatgtgctgtgtcatacctga

SEQ ID NO: 123792 - DNA, 1149 bp, Homo sapiens
  Payload ID: 4292
  Gene Symbol: CDK7
  Gene Name: cyclin-dependent kinase 7
  ENST ID: ENST00000629972
  CDS Start-End: 182-391
ggaacgccaaccgcctgggcctagcgcagcttcctccgcccaccacggaagtgaggcggggatactaaagcgacggagcccagtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaagatctg

SEQ ID NO: 123793 - DNA, 1149 bp, Homo sapiens
  Payload ID: 4292
  Gene Symbol: CDK7
  Gene Name: cyclin-dependent kinase 7
  ENST ID: ENST00000629350
  CDS Start-End: 182-391
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtggtatcgggcccccgagttactatttggagctaggatgtatggtgtaggtgtggacatgtgggctgttggctgtatattagcagagttacttctaagggttccttttttgccaggagattcagaccttgatcagctaacaagaatatttgaaactttgggcacaccaactgaggaacagtggccggacatgtgtagtcttccagattatgtgacatttaagagtttccctggaatacctttgcatcacatcttcagtgcagcaggagacgacttactagatctcatacaaggcttattcttatttaatccatgtgctcgaattacggccacacaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaagatctg

SEQ ID NO: 123794 - DNA, 412 bp, Homo sapiens
  Payload ID: 4292
  Gene Symbol: CDK7
  Gene Name: cyclin-dependent kinase 7
  ENST ID: ENST00000628421
  CDS Start-End: 182-412
ggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtcct

SEQ ID NO: 123795 - DNA, 412 bp, Homo sapiens
  Payload ID: 4292
  Gene Symbol: CDK7
  Gene Name: cyclin-dependent kinase 7
  ENST ID: ENST00000625886
  CDS Start-End: 182-412
ggaacgccaaccgcctgggcctagcgcagcttcctccgcccaccacggaagtgaggcggggatactaaagcgacggagcccagtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacagtttgccaccgtttacaaggccagagataagaacaccaaccaaattgtcgccattaagaaaatcaaacttggacatagatcagaagctaaagatggtataaatagaaccgccttaagagagataaaattattacaggagctaagtcatccaaatataattggtcct

SEQ ID NO: 123796 - DNA, 3055 bp, Homo sapiens
  Payload ID: 4293
  Gene Symbol: CDK8
  Gene Name: cyclin-dependent kinase 8
  Uniprot ID: P49336
  ENST ID: ENST00000381527
  CDS Start-End: 504-1898
cggctgttgtgcggctctgcccttctgtttgagtgtatgggagagtgagtgagtgagtgagtgtgagcgtgtgtgtgagagcgtgaggcgtgagtgcgcgtgtgagaggacgagagcccgcctggccgccccgccgctcccgccgcagcaggagcagaacgcgcggccggagagagcggcggagccggcgcccagggagcccgcggggacaagggcagagacaccgctccccacccccagccctcgtccctcggctctccttcgccgggggatcctccccgttcctccacccccggccggcctctgccccgccgtccccctggatgtccctggcgctttcgcggggcctcctcctgctcttgccgcatcagtcgggctggtgctgcggccggcgggcgtagagcgggcgggttcccgggggctgcggctgcccgtgcttccccggtccccacccctgccccccggccccccgacccagctctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgaaacctgctaatattttagttatgggtgaaggtcctgagcgaggaagagtaaaaattgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 123797 - DNA, 3032 bp, Homo sapiens
  Payload ID: 4293
  Gene Symbol: CDK8
  Gene Name: cyclin-dependent kinase 8
  ENST ID: ENST00000536792
  CDS Start-End: 539-1033
gagtgccctccctcctcctctctttgaggaggtaccggctgttgtgcggctctgcccttctgtttgagtgtatgggagagtgagtgagtgagtgagtgtgagcgtgtgtgtgagagcgtgaggcgtgagtgcgcgtgtgagaggacgagagcccgcctggccgccccgccgctcccgccgcagcaggagcagaacgcgcggccggagagagcggcggagccggcgcccagggagcccgcggggacaagggcagagacaccgctccccacccccagccctcgtccctcggctctccttcgccgggggatcctccccgttcctccacccccggccggcctctgccccgccgtccccctggatgtccctggcgctttcgcggggcctcctcctgctcttgccgcatcagtcgggctggtgctgcggccggcgggcgtagagcgggcgggttcccgggggctgcggctgcccgtgcttccccggtccccacccctgccccccggccccccgacccagctctccggcctcagaggctgtgacaatggactatgactttaaagtgaagctgagcagcgagcgggagcgggtcgaggacctgtttgaatacgagggctgcaaagttggccgaggcacttatggtcacgtctacaaagccaagaggaaagatgggaaggatgataaagactatgctttaaaacaaatagaaggaactgggatctctatgtcggcatgtagagaaatagcattacttcgagagcttaagcatccaaacgtcatttctcttcaaaaggtgtttctgtctcatgctgataggaaggtgtggcttctgtttgactatgctgaacatgacctctggcatataatcaagtttcacagagcttctaaagcaaacaagaagccagttcagttacctcggggaatggtgaagtcactattatatcagatcctagatggtattcactacctgcatgctaactgggtgttgcacagagatttgctgacatgggctttgcccgattatttaattcacctttgaagcctttagcagatttggatccagtggttgttacattctggtaccgagcccctgaactacttcttggagcaaggcattataccaaagctattgatatttgggctatagggtgtatatttgcagaactactaacgtcagaaccaatatttcactgtcgacaagaggacatcaaaactagtaatccttatcaccatgaccagctggacagaatattcaatgtaatgggatttcctgcagataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaa

SEQ ID NO: 123798 - DNA, 795 bp, Homo sapiens
  Payload ID: 4293
  Gene Symbol: CDK8
  Gene Name: cyclin-dependent kinase 8
  ENST ID: ENST00000625988
  CDS Start-End: 1-446
ataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaacgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtg

SEQ ID NO: 123799 - DNA, 586 bp, Homo sapiens
  Payload ID: 4293
  Gene Symbol: CDK8
  Gene Name: cyclin-dependent kinase 8
  ENST ID: ENST00000465820
  CDS Start-End: 1-586
ctgacatgggctttgcccgattatttaattcacctttgaagcctttagcagatttggatccagtggttgttacattctggtaccgagcccctgaactacttcttggagcaaggcattataccaaagctattgataaagattgggaagatataaaaaagatgcctgaacattcaacattaatgaaagatttcagaagaaatacgtataccaactgcagccttatcaagtatatggaaaaacataaagttaaaccagatagtaaagcattccacttgcttcagaagctgcttaccatggacccaataaagcgaattacctcagaacaggctatgcaggacccctatttcttagaagacccacttcctacatcagacgtttttgccggttgtcaaatcccttacccaaaacgagaatttttaacggaagaagaacctgatgacaaaggagacaaaaagaaccagcagcagcagcagggcaataaccacactaatggaactggccacccagggaatcaagacagcagtcacacacagggacccccgttgaagaaagtgagagttgttcctcctaccactacctcaggtgg

SEQ ID NO: 123800 - DNA, 2463 bp, Homo sapiens
  Payload ID: 4294
  Gene Symbol: CDK9
  Gene Name: cyclin-dependent kinase 9
  Uniprot ID: P50750
  ENST ID: ENST00000373264
  CDS Start-End: 101-1219
gcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatgtggtcaacttgattgagatttgtcgaaccaaagcttccccctataaccgctgcaagggtagtatatacctggtgttcgacttctgcgagcatgaccttgctgggctgttgagcaatgttttggtcaagttcacgctgtctgagatcaagagggtgatgcagatgctgcttaacggcctctactacatccacagaaacaagatcctgcatagggacatgaaggctgctaatgtgcttatcactcgtgatggggtcctgaagctggcagactttgggctggcccgggccttcagcctggccaagaacagccagcccaaccgctacaccaaccgtgtggtgacactctggtaccggcccccggagctgttgctcggggagcgggactacggcccccccattgacctgtggggtgctgggtgcatcatggcagagatgtggacccgcagccccatcatgcagggcaacacggagcagcaccaactcgccctcatcagtcagctctgcggctccatcacccctgaggtgtggccaaacgtggacaactatgagctgtacgaaaagctggagctggtcaagggccagaagcggaaggtgaaggacaggctgaaggcctatgtgcgtgacccatacgcactggacctcatcgacaagctgctggtgctggaccctgcccagcgcatcgacagcgatgacgccctcaaccacgacttcttctggtccgaccccatgccctccgacctcaagggcatgctctccacccacctgacgtccatgttcgagtacttggcaccaccgcgccggaagggcagccagatcacccagcagtccaccaaccagagtcgcaatcccgccaccaccaaccagacggagtttgagcgcgtcttctgagggccggcgcttgccactagggctcttgtgttttttttcttctgctatgtgacttgcatcgtggagacagggcatttgagtttatatctctcatgcatattttatttaatccccaccctgggctctgggagcagcccgctgagtggactggagtggagcattggctgagagaccaggagggcactggagctgtcttgtccttgctggttttctggatggttcccagagggtttccatggggtaggaggatgggctcgcccaccagtgactttttctaagagctcccggcgtggtggaagaggggacaggtccctcacccacccacaatcctattctcgggctgagaaccctgcgtggggacagggctcgcctcaggaatgggctgtttttggcctaaccctcagaaacactggggctggcacaaactcttggtttcttcaacaggagaattttactgtgtttcttttggttccattgtttggagacattcctgggcacagtttggtccgttagaattaaaagttgaattttttttttttttaaatttttttttttcctccaggacttgtgtgttttgttctgcgcacacaccgccaactgttcccccacagtcagcagcaggttgggcctgaccattgggacttgattgtcaagtcactggaggtcttgacttttttatctcagttcatgttctcttccataattggaaaggacctttgtctgtttttcctcttgggtgccttccagaacgcatctcatgtccctggtgagggaattggtgagggcctgctgtgagctgctgtggctgcgatggtcacccagctgggcaaatcactggagtgacaatttgacctgtcacctgagaaggatggtccctcagactgctgggtagagggcctggggcaggctggagagagaaagtgggcagagggtgaagggatcacaggggtcttggaaggtggcagtagtttggacgggggtggggagtatgtgggagaaaaaaacagactgaaggtagaatccttgggaacctttgaggagcggcacattctggcaggcacgttttctgtgagcctgaagttaggaagagacattctggaggtcaatttcctacatcctcttacaggcggagaccttgaagtggggccaggaaggaaggttggcaaaacctttgaccagaactgtccttcatttacagaaactgacccagaccacaacacaaaaggccagtaaaagtaagaaaa

SEQ ID NO: 123801 - DNA, 702 bp, Homo sapiens
  Payload ID: 4294
  Gene Symbol: CDK9
  Gene Name: cyclin-dependent kinase 9
  ENST ID: ENST00000421939
  CDS Start-End: 120-702
cgccccgcgcagcccggcggaggcggcgccgtcggaggaggaggagcagggcactgcggctggccccggatcgggcgccagagcggcagcagcttcggcagcagcggcggcccgggcccatgcagcgggacgcgccaccccgagccccagctccggcgccccggctccccgcgcccccgatcggggccgccgctagtagtggcggcggcggaggcgggggcagcggcggcggcggcggaggcgcctctgcagctccggctccccctggcctctcgggaactacaagtcccagggggcctggcggtgggcggcgggcggaagaggcggggtcggcgccgcgaggccggaagtggccgtggaggcggaagtggcgcggccgcggaggggcctggagtgcggcggcggcgggacccggagcaggagcggcggcagcagcgactgggggcggcggcggcgcgttggaggcggccatggcaaagcagtacgactcggtggagtgccctttttgtgatgaagtttccaaatacgagaagctcgccaagatcggccaaggcaccttcggggaggtgttcaaggccaggcaccgcaagaccggccagaaggtggctctgaagaaggtgctgatggaaaacgagaaggaggggttccccattacagccttgcgggagatcaagatccttcagcttctaaaacacgagaatg

SEQ ID NO: 123802 - DNA, 2180 bp, Homo sapiens
  Payload ID: 4295
  Gene Symbol: CDKN1A
  Gene Name: cyclin-dependent kinase inhibitor 1A (p21, Cip1)
  Uniprot ID: P38936
  ENST ID: ENST00000244741
  CDS Start-End: 147-641
gaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaa

SEQ ID NO: 123803 - DNA, 793 bp, Homo sapiens
  Payload ID: 4295
  Gene Symbol: CDKN1A
  Gene Name: cyclin-dependent kinase inhibitor 1A (p21, Cip1)
  Uniprot ID: P38936
  ENST ID: ENST00000373711
  CDS Start-End: 175-669
gagcagctgccgaagtcagttccttgtggagccggagctgggcgcggattcgccgaggcaccgaggcactcagaggagaaactgcaagttgggacttgtccctaggaaaatccagttgctgccaaggtcgtgcagtcactcagccctggagtcaagccagagcaggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcct

SEQ ID NO: 123804 - DNA, 2267 bp, Homo sapiens
  Payload ID: 4295
  Gene Symbol: CDKN1A
  Gene Name: cyclin-dependent kinase inhibitor 1A (p21, Cip1)
  Uniprot ID: P38936
  ENST ID: ENST00000405375
  CDS Start-End: 236-730
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 123805 - DNA, 2104 bp, Homo sapiens
  Payload ID: 4295
  Gene Symbol: CDKN1A
  Gene Name: cyclin-dependent kinase inhibitor 1A (p21, Cip1)
  Uniprot ID: P38936
  ENST ID: ENST00000448526
  CDS Start-End: 73-567
ggtggctattttgtccttgggctgcctgttttcagctgctgcaaccacagggatttcttctgttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 123806 - DNA, 2102 bp, Homo sapiens
  Payload ID: 4295
  Gene Symbol: CDKN1A
  Gene Name: cyclin-dependent kinase inhibitor 1A (p21, Cip1)
  Uniprot ID: P38936
  ENST ID: ENST00000615513
  CDS Start-End: 71-565
aacatgttgagctctggcatagaagaggctggtggctattttgtccttgggctgcctgttttcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgt

SEQ ID NO: 123807 - DNA, 2657 bp, Homo sapiens
  Payload ID: 4296
  Gene Symbol: CDKN1B
  Gene Name: cyclin-dependent kinase inhibitor 1B (p27, Kip1)
  Uniprot ID: P46527
  ENST ID: ENST00000228872
  CDS Start-End: 717-1313
tttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 123808 - DNA, 897 bp, Homo sapiens
  Payload ID: 4296
  Gene Symbol: CDKN1B
  Gene Name: cyclin-dependent kinase inhibitor 1B (p27, Kip1)
  ENST ID: ENST00000396340
  CDS Start-End: 19-636
tgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgta

SEQ ID NO: 123809 - DNA, 577 bp, Homo sapiens
  Payload ID: 4296
  Gene Symbol: CDKN1B
  Gene Name: cyclin-dependent kinase inhibitor 1B (p27, Kip1)
  ENST ID: ENST00000442489
  CDS Start-End: 1-315
aacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagaggattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagt

SEQ ID NO: 123810 - DNA, 1811 bp, Homo sapiens
  Payload ID: 4297
  Gene Symbol: CDKN1C
  Gene Name: cyclin-dependent kinase inhibitor 1C (p57, Kip2)
  ENST ID: ENST00000313407
  CDS Start-End: 191-1108
cccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggcccgggccccagccccggcccgggcccgggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaa

SEQ ID NO: 123811 - DNA, 1220 bp, Homo sapiens
  Payload ID: 4297
  Gene Symbol: CDKN1C
  Gene Name: cyclin-dependent kinase inhibitor 1C (p57, Kip2)
  ENST ID: ENST00000380725
  CDS Start-End: 127-522
ggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcagatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaactcca

SEQ ID NO: 123812 - DNA, 1811 bp, Homo sapiens
  Payload ID: 4297
  Gene Symbol: CDKN1C
  Gene Name: cyclin-dependent kinase inhibitor 1C (p57, Kip2)
  Uniprot ID: P49918
  ENST ID: ENST00000440480
  CDS Start-End: 191-1108
cccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaa

SEQ ID NO: 123813 - DNA, 1570 bp, Homo sapiens
  Payload ID: 4297
  Gene Symbol: CDKN1C
  Gene Name: cyclin-dependent kinase inhibitor 1C (p57, Kip2)
  Uniprot ID: P49918
  ENST ID: ENST00000430149
  CDS Start-End: 283-1233
aggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaaagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaa

SEQ ID NO: 123814 - DNA, 2051 bp, Homo sapiens
  Payload ID: 4297
  Gene Symbol: CDKN1C
  Gene Name: cyclin-dependent kinase inhibitor 1C (p57, Kip2)
  Uniprot ID: P49918
  ENST ID: ENST00000414822
  CDS Start-End: 393-1343
ggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaactcca

SEQ ID NO: 123815 - DNA, 2051 bp, Homo sapiens
  Payload ID: 4297
  Gene Symbol: CDKN1C
  Gene Name: cyclin-dependent kinase inhibitor 1C (p57, Kip2)
  ENST ID: ENST00000616138
  CDS Start-End: 393-1343
ggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggcccgggccccagccccggcccgggcccgggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaactcca

SEQ ID NO: 123816 - DNA, 1220 bp, Homo sapiens; identical to SEQ ID NO: 123811
  Payload ID: 4297
  Gene Symbol: CDKN1C
  Gene Name: cyclin-dependent kinase inhibitor 1C (p57, Kip2)
  ENST ID: ENST00000631604
  CDS Start-End: 127-522

SEQ ID NO: 123817 - DNA, 1570 bp, Homo sapiens
  Payload ID: 4297
  Gene Symbol: CDKN1C
  Gene Name: cyclin-dependent kinase inhibitor 1C (p57, Kip2)
  ENST ID: ENST00000633020
  CDS Start-End: 283-1233
aggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggcccgggccccagccccggcccgggcccgggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaaagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaa

SEQ ID NO: 123818 - DNA, 1218 bp, Homo sapiens
  Payload ID: 4298
  Gene Symbol: CDKN2A
  Gene Name: cyclin-dependent kinase inhibitor 2A
  Uniprot ID: P42771
  ENST ID: ENST00000304494
  CDS Start-End: 272-742
cccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 123819 - DNA, 1149 bp, Homo sapiens
  Payload ID: 4298
  Gene Symbol: CDKN2A
  Gene Name: cyclin-dependent kinase inhibitor 2A
  ENST ID: ENST00000361570
  CDS Start-End: 161-673
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgaccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 123820 - DNA, 794 bp, Homo sapiens
  Payload ID: 4298
  Gene Symbol: CDKN2A
  Gene Name: cyclin-dependent kinase inhibitor 2A
  ENST ID: ENST00000380151
  CDS Start-End: 1-351
atggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtc

SEQ ID NO: 123821 - DNA, 880 bp, Homo sapiens
  Payload ID: 4298
  Gene Symbol: CDKN2A
  Gene Name: cyclin-dependent kinase inhibitor 2A
  Uniprot ID: P42771
  ENST ID: ENST00000498124
  CDS Start-End: 40-543
ggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttccccca

SEQ ID NO: 123822 - DNA, 748 bp, Homo sapiens
  Payload ID: 4298
  Gene Symbol: CDKN2A
  Gene Name: cyclin-dependent kinase inhibitor 2A
  Uniprot ID: Q8N726
  ENST ID: ENST00000530628
  CDS Start-End: 81-479
ggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacgacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaa

SEQ ID NO: 123823 - DNA, 1283 bp, Homo sapiens
  Payload ID: 4298
  Gene Symbol: CDKN2A
  Gene Name: cyclin-dependent kinase inhibitor 2A
  Uniprot ID: Q8N726
  ENST ID: ENST00000579755
  CDS Start-End: 294-692
cgcgcgcgcctccctacgggcgcctccggcagcccttcccgcgtgcgcagggctcagagccgttccgagatcttggaggtccgggtgggagtgggggtggggtgggggtgggggtgaaggtggggggcgggcgcgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 123824 - DNA, 666 bp, Homo sapiens
  Payload ID: 4298
  Gene Symbol: CDKN2A
  Gene Name: cyclin-dependent kinase inhibitor 2A
  ENST ID: ENST00000579122
  CDS Start-End: 32-448
ggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacgacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaaca

SEQ ID NO: 123825 - DNA, 989 bp, Homo sapiens
  Payload ID: 4298
  Gene Symbol: CDKN2A
  Gene Name: cyclin-dependent kinase inhibitor 2A
  Uniprot ID: P42771
  ENST ID: ENST00000494262
  CDS Start-End: 625-942
caaaggactcggtgcttgtcccagccaggcgccctcggcgacgcgggcagctgggaggggaatgggcgcccggacccagctgggacccccgggtgcgactccacctacctagtccggcgccaggccgggtcgacagctccggcagcgccagcgccgcgccgtgtccagatgtcgcgtcagaggcgtgcagcggtttagtttaatttcgcttgttttccaaatctagaagaggagcggagcggcttttagttcaaaactgacattcagcctcctgattggcggatagagcaatgagatgacctcgctttcctttcttcctttttcatttttaaataatctagtttgaagaatggaagactttcgacgaggggagccaggaataaaataaggggaataggggagcggggacgcgagcagcaccagaatccgcgggagcgcggctgttcctgcccaggctaggaggaggaggagataaccgccggtggaggcttccccattcgggttacaacgacttagacatgtggttctcgcagtaccattgaacctggacctcccttcacacagcccctcaatcgtgggaaactgaggcgaacagagcttctaaacccacctcagaagtcagtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcag

SEQ ID NO: 123826 - DNA, 544 bp, Homo sapiens
  Payload ID: 4298
  Gene Symbol: CDKN2A
  Gene Name: cyclin-dependent kinase inhibitor 2A
  ENST ID: ENST00000479692
  CDS Start-End: 16-381
ctggaagcaaatgtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagttacagctagcatccaggtcccgggaggtgaagaaggagacttcggctccagttacagctagcatccgggtcccgatttagaaggagctgccaattacagcgcggttccagggctgagcaaaaagcctgaggagccaagtgggagagggagtaaaactactgaattgggccacaagcaaatgaataaactgaacgactcttaaccaaacctaatatatttaatcc

SEQ ID NO: 123827 - DNA, 678 bp, Homo sapiens
  Payload ID: 4298
  Gene Symbol: CDKN2A
  Gene Name: cyclin-dependent kinase inhibitor 2A
  Uniprot ID: P42771
  ENST ID: ENST00000578845
  CDS Start-End: 128-445
aggggtaattagacacctggggcttgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaa

SEQ ID NO: 123828 - DNA, 926 bp, Homo sapiens
  Payload ID: 4298
  Gene Symbol: CDKN2A
  Gene Name: cyclin-dependent kinase inhibitor 2A
  Uniprot ID: P42771
  ENST ID: ENST00000498628
  CDS Start-End: 485-802
ggttaaaaccgaaaataaaaatgggctagacacaaaggactcggtgcttgtcccagccaggcgccctcggcgacgcgggcagctgggaggggaatgggcgcccggacccagctgggacccccgggtgcgactccacctacctagtccggcgccaggccgggtcgacagctccggcagcgccagcgccgcgccgtgtccagatgtcgcgtcagaggcgtgcagcggtttagtttaatttcgcttgttttccaaatctagaagaggagcggagcggcttttagttcaaaactgacattcagcctcctgattggcggatagagcaatgagatgacctcgctttcctttcttcctttttcatttttaaataatctagtttgaagaatggaagactttcgacgaggggagccaggaataaaataaggggaataggggagcggggacgcgagcagcaccagaatccgcgggagcgcggctgttcctggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatag

SEQ ID NO: 123829 - DNA, 565 bp, Homo sapiens
  Payload ID: 4298
  Gene Symbol: CDKN2A
  Gene Name: cyclin-dependent kinase inhibitor 2A
  ENST ID: ENST00000497750
  CDS Start-End: 76-390
ggaattcattgtgtactgaagaatggatagagaactcaagaaggaaattggaaactggaagcaaatgtaggggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcaggtgaggactgatgatctgagaatttgtaccctgagagcttccaaagctcagagcattcattttccagcacagaaagttcagcccgggagaccagtctccggtcttgcctcagctcacgcgccaatcggtgggacggcctgagtctccctatcgccctgccccgccagggcggcaaatgggaaataa

SEQ ID NO: 123830 - DNA, 3911 bp, Homo sapiens
  Payload ID: 4299
  Gene Symbol: CDKN2B
  Gene Name: cyclin-dependent kinase inhibitor 2B (p15, inhibits CDK4)
  Uniprot ID: P42772
  ENST ID: ENST00000276925
  CDS Start-End: 411-827
gggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtattgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacctgatattaagggaaactaaagaaaatgttattgtggatcccacagtactatattacactgttttttttgtttgttttgttagttttttttatttaaagcaaacctcaaacattattgggtatcaattaccacctggttgtattgaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataaca

SEQ ID NO: 123831 - DNA, 859 bp, Homo sapiens
  Payload ID: 4299
  Gene Symbol: CDKN2B
  Gene Name: cyclin-dependent kinase inhibitor 2B (p15, inhibits CDK4)
  Uniprot ID: P42772
  ENST ID: ENST00000380142
  CDS Start-End: 320-556
ccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctagatcgccgatgtagatttgtacaggagtctccgttggccggaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactga

SEQ ID NO: 123832 - DNA, 2904 bp, Homo sapiens
  Payload ID: 4300
  Gene Symbol: CDKN2C
  Gene Name: cyclin-dependent kinase inhibitor 2C (p18, inhibits CDK4)
  Uniprot ID: P42773
  ENST ID: ENST00000262662
  CDS Start-End: 2035-2541
aacacagaagtaaccagactgccatggtagacatgggagagacgaggaagctgagaaaggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggccagggctcagcgaaggacgccgagtttacagagcgcgcgcgcctagaggaggcagcagcagccgcagcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagg

SEQ ID NO: 123833 - DNA, 1220 bp, Homo sapiens
  Payload ID: 4300
  Gene Symbol: CDKN2C
  Gene Name: cyclin-dependent kinase inhibitor 2C (p18, inhibits CDK4)
  Uniprot ID: P42773
  ENST ID: ENST00000371761
  CDS Start-End: 426-932
ggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaac

SEQ ID NO: 123834 - DNA, 2086 bp, Homo sapiens
  Payload ID: 4300
  Gene Symbol: CDKN2C
  Gene Name: cyclin-dependent kinase inhibitor 2C (p18, inhibits CDK4)
  Uniprot ID: P42773
  ENST ID: ENST00000396148
  CDS Start-End: 1217-1723
ctctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacagg

SEQ ID NO: 123835 - DNA, 1086 bp, Homo sapiens
  Payload ID: 4301
  Gene Symbol: CDKN2D
  Gene Name: cyclin-dependent kinase inhibitor 2D (p19, inhibits CDK4)
  Uniprot ID: P55273
  ENST ID: ENST00000335766
  CDS Start-End: 129-629
agttgcgttcggggcgtggccgggagcacgttggctccgccccctggcggctgcctcagcggcggcggcggcgcaggctcagagcagaccccgcccggcgaggaggagggagggccgccagtgtcgacatgctgctggaggaggttcgcgccggcgaccggctgagtggggcggcggcccggggcgacgtgcaggaggtgcgccgccttctgcaccgggagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattc

SEQ ID NO: 123836 - DNA, 1422 bp, Homo sapiens
  Payload ID: 4301
  Gene Symbol: CDKN2D
  Gene Name: cyclin-dependent kinase inhibitor 2D (p19, inhibits CDK4)
  Uniprot ID: P55273
  ENST ID: ENST00000393599
  CDS Start-End: 326-826
gagcagaccccgcccggcgaggaggagggagggtgagttagggggagacccggcccccaaggggcgggcgccgggcagggccccgcgggcggccgagggttgggcccggctcccagcccctcgccgtcctccggctgacagggggaggagcccgccgggagggccggggtctcgggctggggagccgggacgggagagcagcgcagccgggtgcaccgcggccgcgccccgggagggctgttcgggccagcgcccgccggctgctccgcgctgacagcgccgggctggggcggggcggggggctttgcaggccgccagtgtcgacatgctgctggaggaggttcgcgccggcgaccggctgagtggggcggcggcccggggcgacgtgcaggaggtgcgccgccttctgcaccgggagctggtgcatcccgacgccctcaaccgcttcggcaagacggcgctgcaggtcatgatgtttggcagcaccgccatcgccctggagctgctgaagcaaggtgccagccccaatgtccaggacacctccggtaccagtccagtccatgacgcagcccgcactggattcctggacaccctgaaggtcctagtggagcacggggctgatgtcaacgtgcctgatggcaccggggcacttccaatccatctggcagttcaagagggtcacactgctgtggtcagctttctggcagctgaatctgatctccatcgcagggacgccaggggtctcacacccttggagctggcactgcagagaggggctcaggacctcgtggacatcctgcagggccacatggtggccccgctgtgatctggggtcaccctctccagcaagagaaccccgtggggttatgtatcagaagagaggggaagaaacactttctcttcttgtttctcctgcccactgctgcagtaggggaggagcacagtttgtggcttataggtgttggttttgggggtgtgagtgtttgggggacgtttctcatttgtttttctcactccttttggtgtgttggacagagaagggctcctgcaggccacagccacctaaacggttcagtttcttctgcgcctcaggctgctggggcctcagacgagacccaagggcagagcatttaagagtgaagtcatgacctccagggagcctagaagctggtggccttggccggctgtgctcagagacctgaagtgtgcacgttgcttcaggcatggggggtggggggagcgtcccaaatcaataagaaggtagaatgagttatgagttattcatattctgttggaagcttgttttccagtctcttgtacagcgttttaaaagaaatggattctatttattatgctttattggaaaaaatgttgtaataatttaatgtttttacccattaaattaagacttgtgcatgatca

SEQ ID NO: 123837 - DNA, 893 bp, Homo sapiens
  Payload ID: 4302
  Gene Symbol: CDKN3
  Gene Name: cyclin-dependent kinase inhibitor 3
  Uniprot ID: Q16667
  ENST ID: ENST00000335183
  CDS Start-End: 115-753
acagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaa

SEQ ID NO: 123838 - DNA, 637 bp, Homo sapiens
  Payload ID: 4302
  Gene Symbol: CDKN3
  Gene Name: cyclin-dependent kinase inhibitor 3
  ENST ID: ENST00000395577
  CDS Start-End: 1-501
atgaatccctgttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 123839 - DNA, 845 bp, Homo sapiens
  Payload ID: 4302
  Gene Symbol: CDKN3
  Gene Name: cyclin-dependent kinase inhibitor 3
  ENST ID: ENST00000458126
  CDS Start-End: 70-705
ccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaa

SEQ ID NO: 123840 - DNA, 727 bp, Homo sapiens
  Payload ID: 4302
  Gene Symbol: CDKN3
  Gene Name: cyclin-dependent kinase inhibitor 3
  Uniprot ID: Q16667
  ENST ID: ENST00000442975
  CDS Start-End: 75-593
ctcggccggggcaccggtgagtcgccggcgctgcagagggaggcggcactggtctcgacgtggggcggccagcgatgaagccgcccagttcaatacaaacaagttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattg

SEQ ID NO: 123841 - DNA, 610 bp, Homo sapiens
  Payload ID: 4302
  Gene Symbol: CDKN3
  Gene Name: cyclin-dependent kinase inhibitor 3
  ENST ID: ENST00000543789
  CDS Start-End: 91-537
agctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacatagctgcttgtctcctactatacctgtctgacacaatatcaccagagcaagccatagacagcctgcgagacctaagaggatccggggcaatacagaccatcaag

SEQ ID NO: 123842 - DNA, 1070 bp, Homo sapiens
  Payload ID: 4302
  Gene Symbol: CDKN3
  Gene Name: cyclin-dependent kinase inhibitor 3
  ENST ID: ENST00000541304
  CDS Start-End: 41-481
agagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacaagctttcgaaggtgtcctacggtgactagtttattttctatccattctgccatctttgaggacccacacttctagacagctatagagcttatccttcagcaacaggatctggtaaacctttttcactgacctgttgtctaccagtgctgtctcactggttctgcctggacatttgcagccctttataaaattagtgaacaacactgcttgcctactgtattttgtagtttcttggggctattgtaacaaagtaccacaaaccaggtagctgaaaacaacagaaatttcttctttcccatttctagaggatgtaagtccaaaattaagatgagagcagagccatgccctctgagactgaggagagtccttccatgcctcttcctagcttctggtggtggccatcaatccatggcaggccttggcttgcagctgaatccctccagtctgcctctgtcatcacacacttcctcggatgtctgtgtctttgcatggtgttgtccttgtgtaaggacactagtcatctaggatgagggcctgctctaattcgtcttaacttgaatatacctgcaaagactcaaattctgaataaggtcccactcacaggtacaggataa

SEQ ID NO: 123843 - DNA, 938 bp, Homo sapiens
  Payload ID: 4302
  Gene Symbol: CDKN3
  Gene Name: cyclin-dependent kinase inhibitor 3
  ENST ID: ENST00000556102
  CDS Start-End: 67-678
gggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaaggatctacctacttctcagtttttgccccagtccgttttgggaatggatcctctcacctaggacaatgagatggttattgttaatacaaacttgcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgacaaaa

SEQ ID NO: 123844 - DNA, 196 bp, Homo sapiens
  Payload ID: 4302
  Gene Symbol: CDKN3
  Gene Name: cyclin-dependent kinase inhibitor 3
  ENST ID: ENST00000620759
  CDS Start-End: 1-108
ttgaagcccagttcaatacaaacaagtgagtttgactcatcagatgaagagcctattgaagatgaacagactccaattcatatatcatggctatctttgacaaattagctgcacatctatcatcaagagattcacaatcaagatctgtatcaagataaaggaattcaaatagcatatatatgaccatgtctgaaat

SEQ ID NO: 123845 - DNA, 874 bp, Homo sapiens
  Payload ID: 4302
  Gene Symbol: CDKN3
  Gene Name: cyclin-dependent kinase inhibitor 3
  ENST ID: ENST00000611205
  CDS Start-End: 115-738
acagaaggacgaaccagtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaaaataagctgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 123846 - DNA, 2209 bp, Homo sapiens
  Payload ID: 4303
  Gene Symbol: CDKL1
  Gene Name: cyclin-dependent kinase-like 1 (CDC2-related kinase)
  ENST ID: ENST00000216378
  CDS Start-End: 646-1476
acagcagaagactgccgtggaaccttccctactgtagaggaaagtgctgactttaagcaatttctgcagtcacgccttcctcttctttcctttctccctctcattcattcactgacgccgcagcactgatcagcacagacacagaagatgcctccaagggaccaaagggaataaccgcggttctgaggaccgtgacaaacactcatcgttgggtggggctctagtgcagtccgttggtgccaatattttataagcgacgttttcaaactatgtgaagatcctttcttttcttttctttctttcttttttttttttttttttttttttttttgagacggaatctcgctctgtcgcccgggctggagtgcagtggcgcgatctcggctcactgcaacctgcgcctcccaggttcacgcgattctcctgcctcagtctcctgagttgctgggactacgggcgcccatcaccacacccggctaattttttgtatctttagtagagacggagtttcagtatgttggccagactggtctcgaactcctgacctcaggtgatctgcccgcctcagcctcccaaagtgctgggattacaggcgtgagccaccattctcggctgaagatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggcagagtaccaattgcttcaagaacagaataaggtggagaaaatgatttttcattactacttctagaaactatttatttaatatgtgagtgccatttaggaatgactggaaggaactaaaatcatgactggtgtgttttcctgccttttcccccttcttattgcaactgaagtttcatctttcaaagaagaaaaaaatgacattaataagttaatacaattttgaagaagtaagaagaaggaattttctgttcttttagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttccagcctgcatgagcacaggtctcaacaaggtacatgagtatgagtccagctaaggagactttttgggctttggaaaatgaaatcagattttccccatgc

SEQ ID NO: 123847 - DNA, 1775 bp, Homo sapiens
  Payload ID: 4303
  Gene Symbol: CDKL1
  Gene Name: cyclin-dependent kinase-like 1 (CDC2-related kinase)
  Uniprot ID: Q00532
  ENST ID: ENST00000395834
  CDS Start-End: 29-1105
gatccattttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaa

SEQ ID NO: 123848 - DNA, 210 bp, Homo sapiens
  Payload ID: 4303
  Gene Symbol: CDKL1
  Gene Name: cyclin-dependent kinase-like 1 (CDC2-related kinase)
  ENST ID: ENST00000525911
  CDS Start-End: 1-210
gggatctcattcctaggcaccagcaagtgtttagcacgaatcagtacttcagtggagtgaaaattccagaccctgaagatatggaaccacttgaattaaaattcccaaacatctcttatcctgccctggggctcctaaagttgcagtacctaccccagctaactggcagcagcatccttccagctttggataataagaagtactactgtg

SEQ ID NO: 123849 - DNA, 745 bp, Homo sapiens
  Payload ID: 4303
  Gene Symbol: CDKL1
  Gene Name: cyclin-dependent kinase-like 1 (CDC2-related kinase)
  ENST ID: ENST00000534267
  CDS Start-End: 1-421
ggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactcaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttccagcctgcatgagcacaggtctcaacaaggtacatgagtatgagtccagctaaggagactttttgggctttggaaaatgaaatcagattttccccatgca

SEQ ID NO: 123850 - DNA, 2565 bp, Homo sapiens
  Payload ID: 4304
  Gene Symbol: CDKL2
  Gene Name: cyclin-dependent kinase-like 2 (CDC2-related kinase)
  ENST ID: ENST00000307465
  CDS Start-End: 515-2227
cttgcagctccgcggccaacgccttcgcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtctctagtgaaaaaaacctcttttgggcaagtaagaaaagaagagaatactccaggacagatgtccgtttgcctgaactaaactataatcatctccctgaactaagagcactgggaggcatagctcgaaattccaggctaacaaagaaagagagcaaaattctttcagaatctcgaattccttctctggctgctattgacctgcacacccccagtattacattacatcaggtatcaggacctcccctgtcagatgattcaggggctgatttgcctcaaatggaacaccagcactgagaaccattttggttctgaactggatgatgctcttgcacttgagatgacatcttcttgcagcaagagtgctgatatcccaagaggagagattcatggttttgatcatttccttctgaactgcctgcattttctgaggaaggccttctagaagaaggaaagacaaagacttccaaatgtttcaaaggaagattgaacaaatggccctccccaactgttatcccattacctttcacgtccaccgatgctatttcaagacatatccagtggaataacagtgatatggttcttgttacatgaatgtgtatttactgttaggagattgtatattttaagttacc

SEQ ID NO: 123851 - DNA, 3383 bp, Homo sapiens
  Payload ID: 4304
  Gene Symbol: CDKL2
  Gene Name: cyclin-dependent kinase-like 2 (CDC2-related kinase)
  Uniprot ID: Q92772
  ENST ID: ENST00000429927
  CDS Start-End: 705-2186
cctcctgacgagaaccaaggcgtgtggggacgcagggcctctgcgtgtcagggagcagaacctgggccgagccctaggtgaaggggcggggtggttggccctgagccaatcatggctcgtgacgactcggctcggccaatcagaagaagggaggcctggcgctctcggggcgggtgagaaaccgcccccccttgcagctccgcggccaacgccttcgcccaggggtagttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtatcaggacctcccctgtcagatgattcaggggctgatttgcctcaaatggaacaccagcactgagaaccattttggttctgaactggatgatgctcttgcacttgagatgacatcttcttgcagcaagagtgctgatatcccaagaggagagattcatggttttgatcatttccttctgaactgcctgcattttctgaggaaggccttctagaagaaggaaagacaaagacttccaaatgtttcaaaggaagattgaacaaatggccctccccaactgttatcccattacctttcacgtccaccgatgctatttcaagacatatccagtggaataacagtgatatggttcttgttacatgaatgtgtatttactgttaggagattgtatattttaagttaccatgattaaaagtgtgtaaaaaagggggacagagagaaatactataaaaggccatgttactcatgcattgaactttgtgtgttttctgtataaatgtgtacatttatttaggagtgggtttcttgggggtaggtgataaaaattaggatcagttgaagaaaattgaagaaactaggatcagtaagagaaactgtttgctttacctgaatttaactatgaaaacacacttaacaatcttacacgtttctagatattaagtgaatatgtaactcctgtccatgggtagatgtgtatctttgacttctgtaattatttttgatattctatcagtgtattatgagactctggcctccctgcagatcttctaagaaccacactaatgcaagcgtgacagagaaacctctttcgaatgacttactacaactctggcattggttagttccatgtattgtaagattctggtgctaatgctccatacagaattgatcaggactgattactcttctgtggaccaattgctattgaactacccagctgaagagggtttggggagagaacgttcattattatggactccacttttgtcccctggtagtttaagggtgatactagaatccagagaagttcctgtctccttgtggcctcaaacactcaggccgtctcaaaagcttttcaccaaggtgcaaaatcatttacctgcattccacacatcttttccaatgcatggatccaaaactttttaggtgggaggaataaactaagttggctacaggttcttgatttctgggtttctacacatgctctgcatttatcattttagagaatggttgtttagggaaccagaatttgtgagttttttt

SEQ ID NO: 123852 - DNA, 965 bp, Homo sapiens
  Payload ID: 4304
  Gene Symbol: CDKL2
  Gene Name: cyclin-dependent kinase-like 2 (CDC2-related kinase)
  ENST ID: ENST00000506234
  CDS Start-End: 475-651
ggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaa

SEQ ID NO: 123853 - DNA, 2130 bp, Homo sapiens
  Payload ID: 4305
  Gene Symbol: CDKL3
  Gene Name: cyclin-dependent kinase-like 3
  Uniprot ID: Q8IVW4
  ENST ID: ENST00000265334
  CDS Start-End: 120-1898
ggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctacttct

SEQ ID NO: 123854 - DNA, 1198 bp, Homo sapiens
  Payload ID: 4305
  Gene Symbol: CDKL3
  Gene Name: cyclin-dependent kinase-like 3
  ENST ID: ENST00000519312
  CDS Start-End: 79-399
gtttagaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaagaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagaggtacgtctttatcagcggcatgaagacagaccaatacagtgaattggtaccagtagagtggggcattgctgaaaagatacccaaaaatgtggaagcaactttggaactgggtaacaggcaga

SEQ ID NO: 123855 - DNA, 466 bp, Homo sapiens
  Payload ID: 4305
  Gene Symbol: CDKL3
  Gene Name: cyclin-dependent kinase-like 3
  ENST ID: ENST00000518990
  CDS Start-End: 1-221
atacaaaaggaatggaagttaaacagataaaaatgctgaagagggagtcaaagaaaacagagtcatctaagataccaactttacttaacgtggatcaaaatcaagaaaaacaagagtttattcccttatctctgctgtctgcctgctgtcctattttcacaaatatttgctctcagctaactatcagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttc

SEQ ID NO: 123856 - DNA, 586 bp, Homo sapiens
  Payload ID: 4305
  Gene Symbol: CDKL3
  Gene Name: cyclin-dependent kinase-like 3
  ENST ID: ENST00000521755
  CDS Start-End: 36-170
cagccagacctgtggatatctgggctttgggctgtatgatcattgagatggccactggaaatccctatcttcctagtagttctgatttggatttactccataaaattgttttgaaagtgggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcca

SEQ ID NO: 123857 - DNA, 652 bp, Homo sapiens
  Payload ID: 4305
  Gene Symbol: CDKL3
  Gene Name: cyclin-dependent kinase-like 3
  ENST ID: ENST00000520592
  CDS Start-End: 1-56
agcttaatggattgttggcagatatagttcatattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcca

SEQ ID NO: 123858 - DNA, 1775 bp, Homo sapiens
  Payload ID: 4305
  Gene Symbol: CDKL3
  Gene Name: cyclin-dependent kinase-like 3
  ENST ID: ENST00000523054
  CDS Start-End: 447-1652
aacgggtcacgtgagcgcctcgcctggatgtgagtttcagccagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagaatacaggaaatgcacaaactgaaaggaagaagaacttgccagatgtagagtagaaaatgcagcagctgaaaattcagggaatcccagaatcactggtggagatggccattgcgaggggaagaatttgaagagaaacaggttttttttctggtagtgtcttttcttttacatagtcc

SEQ ID NO: 123859 - DNA, 2160 bp, Homo sapiens
  Payload ID: 4305
  Gene Symbol: CDKL3
  Gene Name: cyclin-dependent kinase-like 3
  ENST ID: ENST00000521118
  CDS Start-End: 116-1888
ctacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagaatacaggaaatgcacaaactgaaaggaagaagaacttgccagatgtagagtagaaaatgcagcagctgaaaattcagggaatcccagaatcactgtatggttttttaaaaatcctttttattaatgttacatacacaaaaatgctaactagataattttacaggtatatcgtaaatcctgttagttatatgtacattcacctaaatttgtttttaaatttattaatctttaaattattcatgttttcttaatttgaacatgaatttataaaaactacctgactggtacatcctaataaaattgcagcttacatttagtcatataa

SEQ ID NO: 123860 - DNA, 1501 bp, Homo sapiens
  Payload ID: 4305
  Gene Symbol: CDKL3
  Gene Name: cyclin-dependent kinase-like 3
  Uniprot ID: Q8IVW4
  ENST ID: ENST00000523832
  CDS Start-End: 1-1368
atggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcca

SEQ ID NO: 123861 - DNA, 1417 bp, Homo sapiens
  Payload ID: 4305
  Gene Symbol: CDKL3
  Gene Name: cyclin-dependent kinase-like 3
  ENST ID: ENST00000520693
  CDS Start-End: 74-322
gaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagtttattcccttatctctgctgtctgcctgctgtcctattttcacaaatatttgctctcagctaactatcaggtacgtctttatcagcggcatgaagacagaccaatacagtgaattggtaccagtagagtggggcattgctgaaaagatacccaaaaatgtggaagcaactttggaactgggtaacaggcagaggtttgaacagtttggagagctcagaagaagacaggaaaatgtgggaaagtttggaactttctagagacttgttgaatggctttgacc

SEQ ID NO: 123862 - DNA, 1567 bp, Homo sapiens
  Payload ID: 4306
  Gene Symbol: CDKL4
  Gene Name: cyclin-dependent kinase-like 4
  Uniprot ID: Q5MAI5
  ENST ID: ENST00000378803
  CDS Start-End: 1-948
atggaaaagtatgaaaaattagctaagactggagaagggtcttatggggttgtattcaaatgcagaaacaaaacctctggacaagtagtagctgttaaaaaatttgtggaatctgaagatgatcctgttgttaagaaaatagcactaagagaaatacgtatgttgaagcaattaaaacatccaaatcttgtgaacctcatcgaggtgttcaggagaaaaaggaaaatgcatttagtttttgaatactgtgatcatacacttttaaatgagctggaaagaaacccaaatggagttgctgatggagtgatcaaaagcgtattatggcaaacacttcaagctcttaatttctgtcatatacataactgtattcacagagatataaaacctgaaaatattctaataactaagcaaggaataatcaagatttgtgacttcgggtttgcacaaattctgattccaggagatgcctacaccgattatgtagctacgagatggtaccgagctcctgaacttcttgtgggagatactcagtatggttcttcagtcgatatatgggctattggttgtgtttttgcagagctcctgacaggccagccactgtggcctggaaaatcagatgtggaccaactttatctgataatcagaacactaggaaaattaatcccaagacatcaatcaatctttaaaagtaacgggtttttccatggcatcagtatacctgagccagaagacatggaaactcttgaggaaaagttctcagatgttcatcctgtggctctgaacttcatgaaggggtgtctgaagatgaatccagatgacagattaacctgttcccaactcctggagagctcctactttgattcttttcaagaggcccaaattaaaagaaaagcacgtaatgaaggaagaaacagaagacgccaacaggtacttccgctcaaaagttaaagtgctataaaaataattccttttttgtttttgtttgtctgcctttcaaagtgagacaaggtggacaccaagacctttcatttgtactggtgtagttgtatttgtctagcttaataaatattggtaattgatgtaataaaaccatagaactatgaaaatatcaagattattgcaaaaatcttattccaaacacacctgaatcaaatcgttacgcaactctttggctgctctgattggatatcccacccacaagatcgtatacccataatataacaacttcatataataaaatgctgattccaacaggactgagttttgccagcattgcaaaggaatccaagtgcctttctgtagcctccagatgtgcaataacggtaacttgactcttccatcttttcacccacagcaggcacctaagtctgcctttcctaggctttttctcaaaaccaagatctgccaggtacaaaggaatgaaacccagacatctgggaaccaaattctacccaatgggccaatattgcagaacagtatggtgactgttatgacaaacattaattctgcagtttatcaggtgactgtccttcacttgctttcagaaaactttgaagttaaatcgtaa

SEQ ID NO: 123863 - DNA, 1140 bp, Homo sapiens
  Payload ID: 4306
  Gene Symbol: CDKL4
  Gene Name: cyclin-dependent kinase-like 4
  Uniprot ID: Q5MAI5
  ENST ID: ENST00000395035
  CDS Start-End: 1-1140
atggaaaagtatgaaaaattagctaagactggagaagggtcttatggggttgtattcaaatgcagaaacaaaacctctggacaagtagtagctgttaaaaaatttgtggaatctgaagatgatcctgttgttaagaaaatagcactaagagaaatacgtatgttgaagcaattaaaacatccaaatcttgtgaacctcatcgaggtgttcaggagaaaaaggaaaatgcatttagtttttgaatactgtgatcatacacttttaaatgagctggaaagaaacccaaatggagttgctgatggagtgatcaaaagcgtattatggcaaacacttcaagctcttaatttctgtcatatacataactgtattcacagagatataaaacctgaaaatattctaataactaagcaaggaataatcaagatttgtgacttcgggtttgcacaaattctgattccaggagatgcctacaccgattatgtagctacgagatggtaccgagctcctgaacttcttgtgggagatactcagtatggttcttcagtcgatatatgggctattggttgtgtttttgcagagctcctgacaggccagccactgtggcctggaaaatcagatgtggaccaactttatctgataatcagaacactaggaaaattaatcccaagacatcaatcaatctttaaaagtaacgggtttttccatggcatcagtatacctgagccagaagacatggaaactcttgaggaaaagttctcagatgttcatcctgtggctctgaacttcatgaaggggtgtctgaagatgaatccagatgacagattaacctgttcccaactcctggagagctcctactttgattcttttcaagaggcccaaattaaaagaaaagcacgtaatgaaggaagaaacagaagacgccaacagcaggcacctaagtctgcctttcctaggctttttctcaaaaccaagatctgccaggtacaaaggaatgaaacccagacatctgggaaccaaattctacccaatgggccaatattgcagaacagtatggtgactgttatgacaaacattaattctgcagtttatcaggtgactgtccttcacttgctttcagaaaactttgaagttaaatcgtaa

SEQ ID NO: 123864 - DNA, 724 bp, Homo sapiens
  Payload ID: 4306
  Gene Symbol: CDKL4
  Gene Name: cyclin-dependent kinase-like 4
  ENST ID: ENST00000451199
  CDS Start-End: 1-375
aaattaatcccaagacatcaatcaatctttaaaagtaacgggtttttccatggcatcagtatacctgagccagaagacatggaaactcttgaggaaaagttctcagatgttcatcctgtggctctgaacttcatgaaggggtgtctgaagatgaatccagatgacagattaacctgttcccaactcctggagagctcctactttgattcttttcaagaggcccaaattaaaagaaaagcacgtaatgaaggaagaaacagaagacgccaacagaatcaactgttgcctctcataccaggaagccacatctcccccacacctgatggaagaaaacaagtcctccagttaaaatttgatcaccttccaaacatttaggaaaatgttctttcaagtgcaaagtaatttaatatgtacacattttgtacaagtgagataggaattctcagtgtttcaaatgcaaatgagccatatgaaaattaagatgccttctagaattgttttgctctgatcattgctgattcctttccccatgttttacatgccaactttatcttttagaatattttctttaaatgttataaagcctaaaactgcacatatggaagagacattttcaatttcatcagagcagcccctcccgaggctatctatatggagaatttgtgagcttatactttgatttatgaaaaagatttacatgtgtcatcttgcttcagctgaccac

SEQ ID NO: 123865 - DNA, 388 bp, Homo sapiens
  Payload ID: 4306
  Gene Symbol: CDKL4
  Gene Name: cyclin-dependent kinase-like 4
  ENST ID: ENST00000419111
  CDS Start-End: 57-233
gtgcagcattgtactgcaagtcaatcgatacaataatttaagtcacttcagctataatggaaaagtatgaaaaattagctaagactggagaagggtcttatggggttgtattcaaatgcagaaacaaaacctctggacaagtagtagctgttaaaaaatttgtggaatctgaagatgatcctgttgttaagaaaatagcactaagagaaatacgtatgttgaagagttgctgatggagtgatcaaaagcgtattatggcaaacacttcaagctcttaatttctgtcatatacataactgtattcacagagatataaaacctgaaaatattctaataactaagcaaggaataatcaagatttgtgacttcgggtttgcacaaattctga

SEQ ID NO: 123866 - DNA, 3463 bp, Homo sapiens
  Payload ID: 4307
  Gene Symbol: CDKL5
  Gene Name: cyclin-dependent kinase-like 5
  Uniprot ID: O76039
  ENST ID: ENST00000379989
  CDS Start-End: 286-3378
acctcaggactctttagagctctgagtgagtggggtgggggagttggaggaggaagaccctacaggaagttgagctgtactctccaacaggcgagcacatggtcgtctcctctctcccttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaa

SEQ ID NO: 123867 - DNA, 3449 bp, Homo sapiens
  Payload ID: 4307
  Gene Symbol: CDKL5
  Gene Name: cyclin-dependent kinase-like 5
  Uniprot ID: O76039
  ENST ID: ENST00000379996
  CDS Start-End: 276-3368
gagggcggggccggaggtttcgattagttgtctctgccgctggggaaggtaaagcggcgacggcgtcctcaggagctgtggggtcccctgctagaagtgggggactcggcgggggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaacca

SEQ ID NO: 123868 - DNA, 2632 bp, Homo sapiens
  Payload ID: 4307
  Gene Symbol: CDKL5
  Gene Name: cyclin-dependent kinase-like 5
  ENST ID: ENST00000463994
  CDS Start-End: 279-2632
aatttctgtgacccccagtggtttcacactatcttttcagcaagccacattggatttcacgcatttactgactcttctacccgttctttttggtgtccagctgtactctccaacagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaa

SEQ ID NO: 123869 - DNA, 12533 bp, Homo sapiens
  Payload ID: 4307
  Gene Symbol: CDKL5
  Gene Name: cyclin-dependent kinase-like 5
  Uniprot ID: O76039
  ENST ID: ENST00000623535
  CDS Start-End: 1-2883
atgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccaggtcagatggatcctggttggcatgtgtcctctgtgaccaggagtgccacagagggcccttcctactctgaacagctgggtgccaaaagtgggccaaatgggcacccctataacagaacaaatcgctcacgaatgccaaatctgaatgatttaaaagagacagccttgtaatttgtgctggtaggggggaggggtggacagacaagccagtggggaggggtgggaaagggtgggctgggcttggggcatgggccgggccaagtggtgagccaatattttcagctttatgaaggtgtgtgcaatattgcatgtgttggggccgttgagctcctcgcggccacaaatgctagtcagggatcttagagccacaggagttccttagggatcgccactccccacaggtcttgtgtgagaatagatagagtgtgccattgaggaagaagaaattcttgccagtttctcccctttacattccagctttagtgcaatctctgttgaacttgggaatgccaggatgtgtcctggcactgcaagggataggaaagtcgtgttgaccgatgcccttactacatatttttttctgcctagagtaaatgtggggtttattgtaatccaagagtatccctttgaagggttagcagatgaactgtatgtcttaaattgttttctaaacttccatatttgataggatttgtaacatttatttataattaatattgtactgttaaaatcatatcttttatgttataatgtaaagttattttgagctgtttgaaacattgtgaagcagtgggacagctacagtagtttctataaaaactaaacagtaacatttatatattgcatcaggagtattttattctatatataatatatatatatggtaaatatctgttttataaatatattcatttaaagaaagtatcgttatgacactatctgccatatttttatacatttgtgatatgaagtgagtattatacttctactaaagggagttgaattgtggctacacgtgactgtaacagtatgaaccttgctcaactttgaggccccagcagtagcctctagacatgatccttggtagcagacgagatgcagcatctctttccaaacctgcaggggaagaaagtcagataggccagtgagaattccagcaggcctggtttccgtcctcacacacttggctcctgtttgtgtccagggacgttacttgcacacaggggagaatagattgaggcgttactcgtgggtctttgtagagagaatgtgctcttccacttagcattagtgtagagcgtagaccaaagatttgccagtgaacattccttgttgtgagatcataagaggtacctgtctgcagatcttgcaaaccatctctatgctcctgaatattgtccactgtcccggagactcttggctgatggggtgtgagatatatgtgtggcatttctatttctgaatgccttttttgctattgctctctccaataccatatttaaaaggctcctggagcaattccagatagataaaaaattactctatccatttttttcttcctggggctgtccacttatgacaagattttcatgcacacctgttacgcacacaacccccatcagaacaggacctatcttcccctcatctgatctctttcagctcccaagttactcccaagtatcatcaaaccctttggccatcaagtgttatcctcccatgcctctgggtcatccttgagggaagtcacctcagcaccatcatctatcagtagtagtagatttttggaattagtctctgagcaataatacttttaaaggtccctcccacccctcaaagagataacttctcagtatttattacttgtcctcaaattctgagtgtcagcccctgcatcaagtcagctatgatcaaaatgtgctgttactgttaaccctcccccgagattttgagaatcatagctctgatgattatgaagattataaagactaaggtcctagtttccctgaagcttaaattgtgcacatattgcatttttatataaatactataatgtgtattgattatatagataggtcattttaaggtgctttttatttaattttaatgagtgtaataggcactaaaatgaaactcgactgggtactattactgaaaaaatttgactcaaaccaatagttttgcatgctctttagttctttttctgtcttacttctttcaccagttcagtactgtttgggtagctctgaattctggcttttccaggcagctgcttgatgatacaaatgaggtggaccatcagcagttttgcctggacactaatgactctaaaagggtgtgtatttaactcttctttttcatactagatctctaccttgtattccccccttgcaaaccagaaactacactttttttctctggaaagacttctcactgtgctatgcgcttaggaactgcacggtcccgttgccatgctgtggcattcgaggctcgtcacctaggggctggtttcccatgttgtcatccttgctaacactgggatctcagatgtttgcagaacatttctattcatgacggttcttcaaagaagggctagaatatttgccttctacctagagcaaagtaaacctaattgttgaagagtcaatacgtactttttgtactttcccagatttgagccagaaaatacctacagatatctacaaatgttttcaaccagtgttttcgaggtagctctttaatcctcttctcagcttttgtctgttctgacttttcatccaataagctgtaagtgaactacaatctgcatttccagcatgcaattctcttcctgctcacggagggggatgcaaaagttttctctcacacctaatgggccctctcttagcttttaactgttgttttcccctgttgatgaaaaattactgacatcacaaagattgccatccatggtagaaaggacttgatttaaagtcagaaaaatttgccttttctttaggaaggggaattcatgacatccatgtcctattatcggccgtaacttcctaaagaagaaaaagggtgaatgaaagcttatgttacttttatgaaagtatcactgatctcctttggaaaagaaactctgcttcactgtttttctacctttatttctctgccatcctcgtttttcctctctgaagttctaaataccctttaactgaaccttgttggtcttgctctaaaatttagcctctttctagagcccaagaccaaaagggagtgcttcatgctgaggggctcaagtgagctgactctacaactgtggttctcaactaggggcagatttacccccaagggtacatttggcaatgtctggggacatttggttgtcatagctgggggggaggtgatggtatgctactggcatcaagtggttagaggccacagatgctactaaacaccctgccatgcacaggacagccccccaaacaaacagtggtccagccccaagcactactagtgctgaggttgagaaaccctgccctacaccatcccaagcccaccagtctgcagagcttggctctggccttgttctgtccaggctacagtactgcaggtgtgatttcttcaacatcacattctcttaagagtcttcaaccactatgcctgaatccttggaatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgtttttgaaaggggacatagaaaagacagtacaaaggttgtaagtgtcctgtcgctaattcccagggccagaatctcacaagaagatcctctcaaagacttaaaagcctggcttacaaaaataaccagaaaccaaacttgtaagcagttacaatttcttccttttgcttcttgaccagctgagatacagaatatcttgaggtctggttcagctgatgaaaaattctgtctcagaaacgatgagtaagaaaccatacaagaaaaagaagtccctcatctatctgcatacacgcaatgtgggagaagtggggtggctaggaaactctgggcctgctgcccccttcgattctttttttttttctttgtgaattgaatgtacgatacaaatggtaggccttcatgtgagccagttactacatgaatcttcatttcccacagtggtttgttcattcatcagcgttaggcttggtcctggctccacctttctcctctccgggcactgaccccacctttccgtgtatttactgtaggctattaaatatgatcatgacccgccttgcattttcattcatcacctgtttatgcccaaatttaaaggaagtttgtctcattttgccagaaaaaaattgtaatagtcggcacgctggatttgtagggccagcaaaattgcggcagtgaaactagtttcacttctaaagcccttcatttcccacaaggttaagctctcgaaaccccatttgatccttggttcctatttcgatcctcctttggaatctgaaaatcggtctccatgttgtatgcagattagaagttgccttgtttgttactcttccaacacagggtatcagggagaaagaggccttatctgttcctccatcccccctgttttgacagactgctaagaattcctcaggacttcctttggttggggattttactttcccaaaagtctgatctgatttctttcaggggtagacaagcttgtcctagtgctctgcttcaggtcttatcagaagaaacccaggaatagaaaaggtagatgccttgacttttgtccctgttgtggggactaaagtgttttttgccagaattgtcaaaagctccggttcaaactctgtagagtttcatggaaaaacaaaacaaaacaaaaaagatgcttatcgtcccggagaatgtgtaagtaagttctccagcacggcttaggttttccaaaatggaaagcaaagcttgcagacaacctgttttctctagagacacacaatgattctggccctcagtctgtttccctccccttgtttactctttggtcaccgatcgagtcaggctagaggggtaatacggtgattaaaagaagtaaattctcactgtaaacttggattgattaacagaaacaattaaaccaaacaaaatcattgccccaaatttctatctccaagaattgctttgtgccattttgaattcaggtagttattctgtatatacttagctaactattcagagcttcttcaatctctagtaagcttgaaggtggtgtctgggaagacacagggcagggtgacatttagactctgttcattcttaaaaatagggataagccagaatgatgtgacatctagtatgtggtagatgaagaatcagtggaaattcttaattgcacagactttataatccattatataaagtgtaattccatactttttactgtggcaagggtgtgatgtgattgttaatctttttaatttttgaatccaaactgaatttaaagtgttgaatacttaaatcctcacaagtgaattatgaaccatttgtaaagtgtttctataactctttgtatcatgtgttggtacatcttatcaagttttttctggcatgtaattccattctaaacttatgtaaaatttctattgttgctgtaaatattacacaaatatctattccgtgataaccttcattatcagcatgaaatggttaatttttactgagcacaatgtatttttgaatggatcttcccaaatgtctttaataaaatgcagattttgcactgactgatgtgactgccaggccgtcccaatcttgagcactgtggtccttcgtgtttgaactgcgaacagctccattttagttccttcttgggaagaaagaatgcattcgaattcaaatgagggatgatgggcctttgaggttgtaatcagtttgagacagaaattaatgtaaaactaggcaaatcctgtaacttaatgatgttgatctttgttttcctatttataaagcttttttccccttacggcattttgaaaactttggtttgttttatacttgagtgttgtcacctttgcacgtcgctagacactcacgtggtagtttgaggaggatgggaagagaggccaatcttgtgctaagtgctatggagaaagcaaagatgcacagcttaataagggttttttgattctagaggagaggtgggcaagcttttcctgtaaagggccagatggtaaatattgggggctctgtggcccatcagttccctgtcaacattactcagctctgcctttgtattgcagaggctgcatggataatatgtaaatcagtaagtgtggctgtggtcccgtaaaactttacttatagaaacaggccatagtttactaacccgttttaggccctcagtttcatcatttagggtaacaccaaccgagtacatgttcaatcaggagggaaagaacttagcttttgtgataacttatagatgaaatattccccagttttctttctctttctaaacaaagggtaggagctgaaagtcagtgctctccattcttaaaagtcctctgtcaaccacctcttcactctatctccttaagtgacatggaaacttgtggcctgtgctttcaactataatcttaccaagactgaatgaaagtatttggtgcttatactttttaatgttcatagcacttactatggccaggcacaatgcccaagtgttttgctttattattattattattattattattattattattattattattattttcacaacaacccagcgaaacaggtactattattatcccctttttgtaaatgaggaaacagatttccatacttgacattaacctgcccaaggtcacccagtttggaagtggcagggccaggatttgaagccgaatatgttcattgtaaagcccatatacccttaaaagtcactgcacgtccacgtatggtaatgtggtcacaatcagtattgtttctctttagtaattcagatttattcaagtaactccaaggttcaaattttcaaaaacagtttccaacacaggttatattaaaaactttgcctgaagtttactctaggtgcagaaataaagacaacttagtcaagtgaaggaaagggtaacagacttagaaatggctatctacactgatggaataagtatactaattagagcaggtaacaagtccccacgatgtataacatattcttctctaaaagctcacaacaatttatgtgccaccttccatcccctttcccagcagatggtaattgatgcaatttgagaatagaacacttcattgaaacaagtcactggaggtcctctggggatgcagcttaaaagcccaggatcaggccaggtgtggtggctcacgcctgtaatcccagcactgtgggagactgagacgggcagatcacctgaagtcaggagttcgagaccagcctggccaatatagagaaaccccgtctgtactaaaaatacaaaaattaggtctgggcggtggctcacgcccgtaatcctagcactttgggaggccaaggtgggtggatcacgaggtcaggagttcgagaccagcctggccaacatggtgaaaccccgtctctactaaaaatacaaaaattgggtgtggtggtacatgcctgtaatcccagctgcttaggaggctgaggcaggagaatcacttgaacccaaaaggcagaggttgcagtgagccgagatcacgccactgcactccagcctggcaacagagcgagactctgtctcaaaaaaaaaaaaaaaaaaatacaaaaattagccgggaatggtggtgaatgtctataatcccagccactcgggaggctgaggcaggagaatcacttgaacccaaaaggcagaggttgcagtgagccaagatcgcaccactgcactcccacctggacgacagagcgagacgccatctcaaaaataaataaataaataaatccctaggatatagagtccgcttgcctgggtggagtcttggctccatctcctacatctcatgtgacttgaagcaaggcacttcactatgcctcagtttccttatctttaaatggaggtaatcacagtacctacctcagtgttgttgtgaagatttaatgagataataacctgcagagcacttgagagtctcaagaaatatgagctcttataacattattgctattgtaaaacattgctattacttctgtcccaatttggcagtttcaggaaattgagaaggaatgtcactgaatctttaatgccagttacacagagctcagtaggtgtccgcacagccctttagatgcacgtagcctatttgatcttcgtatcagccctgtaaggttgggcttaagaatgacccagcatggaagtactcttgggaccacaggggaagcaacagtccttgtaagctgtttgtcagtgggccttagcaaccaagccccaagtggacagaaagatggggttctgtgagcatccattccaagggtcactttaggggtgcaatcttctgggctctgagaatggattcacagcagcatctctatctggaaatacctttgctttgtccaagtaacctcctcccacacagagtacccgaatcagctcagattttttttccttaatattggcaacacttaatgctacttctttgttcgtaacatttcatttaattatttaaaaatctgcaaatgttgtgtatattttaccgcaatttttaaacaaactccagtgtagaccgtgctctagcatttctaaaaataaaagtaaatatgttaaaataa

SEQ ID NO: 123870 - DNA, 564 bp, Homo sapiens
  Payload ID: 4307
  Gene Symbol: CDKL5
  Gene Name: cyclin-dependent kinase-like 5
  ENST ID: ENST00000624700
  CDS Start-End: 359-564
gagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagca

SEQ ID NO: 123871 - DNA, 483 bp, Homo sapiens
  Payload ID: 4307
  Gene Symbol: CDKL5
  Gene Name: cyclin-dependent kinase-like 5
  ENST ID: ENST00000623364
  CDS Start-End: 302-483
gggggagttggaggaggaagaccctacaggaagttgagctgtactctccaacaggcgagcacatggtcgtctcctctctcccttcaggctgctcatcttcaaggggaaaacatggctactggatttcctctgttctaagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagct

SEQ ID NO: 123872 - DNA, 567 bp, Homo sapiens
  Payload ID: 4307
  Gene Symbol: CDKL5
  Gene Name: cyclin-dependent kinase-like 5
  ENST ID: ENST00000624953
  CDS Start-End: 515-567
gtgagtggggtgggggagttggaggaggaagaccctacaggaagttgaggtatcatatcctcaatttctgtgacccccagtggtttcacactatcttttcagcaagccacattggatttcacgcatttactgactcttctacccgttctttttggtgtccagctgtactctccaacaggcgagcacatggtcgtctcctctctcccttcaggctggtctggaactcctggcttcaagtgatcctcctcagcctcccaaagatctgggattacaggtgtgaaccactgcacctggcctagttttatttgctaatgacaagtcaacagtcagtttagttgtaatttcgttgtagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggt

SEQ ID NO: 123873 - DNA, 2106 bp, Homo sapiens
  Payload ID: 4308
  Gene Symbol: CYLC1
  Gene Name: cylicin, basic protein of sperm head cytoskeleton 1
  Uniprot ID: P35663
  ENST ID: ENST00000329312
  CDS Start-End: 38-1993
actatgctcaagtccaggcaacgtacaggcaggggaaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgcctgaagcaccgtggattcataagctgctttaaagaacaactgagcacttggtttcacagaatggccttaccacagtaagcaccacctactctcaaatgagcatttctacctctgtggaactgaaataaaaacaagtcttccatga

SEQ ID NO: 123874 - DNA, 379 bp, Homo sapiens
  Payload ID: 4308
  Gene Symbol: CYLC1
  Gene Name: cylicin, basic protein of sperm head cytoskeleton 1
  ENST ID: ENST00000621735
  CDS Start-End: 58-264
aacattaccagtttcaacttactatgctcaagtccaggcaacgtacaggcaggggaaatgtctcttccaaggctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactcctgaagcaccgtggattcataagctgctttaaagaacaactgagcacttggtttcacagaatggccttaccacagtaagcaccacctactctcaaatgagcatttctacctctgtggaactgaaataaaaacaagtcttccatgagt

SEQ ID NO: 123875 - DNA, 2053 bp, Homo sapiens
  Payload ID: 4309
  Gene Symbol: CYLC2
  Gene Name: cylicin, basic protein of sperm head cytoskeleton 2
  Uniprot ID: Q14093
  ENST ID: ENST00000487798
  CDS Start-End: 38-1084
acaatacttaagtcctggcaagtcataagtggggaaaatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgatctactacagaatttaagaaggcagttgttctattcataattgctcacaatcagcctctcctcctactactgttcctactctctataccctttgtgtctgctcagactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccata

SEQ ID NO: 123876 - DNA, 2171 bp, Homo sapiens
  Payload ID: 4309
  Gene Symbol: CYLC2
  Gene Name: cylicin, basic protein of sperm head cytoskeleton 2
  Uniprot ID: Q14093
  ENST ID: ENST00000374798
  CDS Start-End: 71-1117
gatgtcacctttcaacatcaccagtttgaacttacaatacttaagtcctggcaagtcataagtggggaaaatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttgtctcgctctgttgccctggctggagttcagtgacatgatctcaggcttactacagcctccaccttcaggttcaagtgattctcctgcctcagcctctctggtagctgggattacagggaaggaaaatagctggcatttcttgctggagaaagttatcacaagtggaaaggttaccctagaaacaaaagatgactaccgtgaggatggattggacattacaccacactggaaaagtgaaacatctcattcagttggtgatcttcctgtcatgaaagttgcttgacagctctaattacgaattgaacacattaaacacctggtgaaattatcaattaaaaacatctagtcaccata

SEQ ID NO: 123877 - DNA, 1817 bp, Homo sapiens
  Payload ID: 4309
  Gene Symbol: CYLC2
  Gene Name: cylicin, basic protein of sperm head cytoskeleton 2
  Uniprot ID: Q14093
  ENST ID: ENST00000612124
  CDS Start-End: 71-1117
gatgtcacctttcaacatcaccagtttgaacttacaatacttaagtcctggcaagtcataagtggggaaaatgtctctcccaagattccaaagagtaaactttgggccatatgataattacattccagtcagtgaattaagcaaaaaatcatggaatcagcaacactttgccctgttatttcccaaaccacaacggccaggaaccaaaaggagatcaaaaccttctcaaatacgggacaacacggtttctataattgatgaagaacaattaagaggagatcgtagacaaccattatggatgtaccgttctttaatgagaatttctgagagaccatctgtttatttagctgccaggaggcagcctctcaaaccaactcgtactgtcgaggtggattctaaagcagcagaaattggtaagaaaggtgaagacaagacaacacagaaggacacaacagattcggaatcagaattaaaacaaggaaaaaaagattcaaagaaaggcaaggatatagagaaaggaaaagaagaaaagctagatgcaaagaaagatagcaaaaaaggtaaaaaggatgcagagaagggcaaagactcagcaacagaatctgaagatgaaaaaggaggtgcaaagaaagataacaaaaaagataaaaaggattcaaacaaaggcaaagactcggcaacagaatctgaaggtgaaaaaggaggtacagagaaagatagcaaaaaaggtaaaaaggattcaaagaagggcaaggattcagccatagaattacaagctgtaaaagcagatgaaaagaaggatgaggatggaaaaaaagatgcaaacaaaggtgatgaatcgaaggatgccaagaaagatgcaaaggagattaaaaaaggtaagaaagataagaagaagcccagtagtacagacagtgactcaaaggatgatgtcaagaaagagtctaagaaggacgccacgaaagatgccaagaaagttgccaagaaagatactgagaaagaatctgctgattcaaagaaggatgcaaagaaaaatgctaagaaggatgcaaagaaggatgcaaagaagaatgcaaagaaggatgaaaagaaggatgcaaagaagaagggcaagtaggccttggataagaatttgaaccgaaagaataattcaaaagcatatttgatgaaacaatagtggtagtctgcagctgaatttgtgagaaaacaagaggcctcaaagaattaaataatttttaaaaggtggtaaagaaggatacaaaggagaactcagcagagatttataaaaatatataagaaagatgttaagaaaaattaaggggggatccattgaaagacttgaagaatacatatacttatattcggggatatgaaggattcaatgaatgatctctagaaagatttaaagaagaatattcagataaggatgttgaagataatgacactaaatctatggacacacacacacacacacacacacacacacacacacacacacacacacacacacagtttaatgaaggcttaaagaatccaaggagacagatgttgtatctatagatttaaaataatctcaagctgcatccacagatacaaaaaaatataggagccatgaaatgaagttaaacaccttgtagaaagcctactttcaagtaaatatagcattcctttggcaaaaagaaaaaaaaagtaaaagaaaagaaaaaaaatgtattaccacccgatgagcctacatctttctttctgaagtttaaacaaccacagtcatgtttatggttgttggatgtgccacttccaatccaaaagaagcacacttg

SEQ ID NO: 123878 - DNA, 5371 bp, Homo sapiens
  Payload ID: 4310
  Gene Symbol: CYLD
  Gene Name: cylindromatosis (turban tumor syndrome)
  Uniprot ID: Q9NQC7
  ENST ID: ENST00000311559
  CDS Start-End: 392-3262
gggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagctttatcagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaa

SEQ ID NO: 123879 - DNA, 3536 bp, Homo sapiens
  Payload ID: 4310
  Gene Symbol: CYLD
  Gene Name: cylindromatosis (turban tumor syndrome)
  Uniprot ID: Q9NQC7
  ENST ID: ENST00000398568
  CDS Start-End: 301-3162
cggaggtaaatactagggcggtgggtgtggggagccggggccggcccgggacgcgggctggggagccggggcgaggggcgacgccccgccgcccgagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatgga

SEQ ID NO: 123880 - DNA, 8503 bp, Homo sapiens
  Payload ID: 4310
  Gene Symbol: CYLD
  Gene Name: cylindromatosis (turban tumor syndrome)
  Uniprot ID: Q9NQC7
  ENST ID: ENST00000427738
  CDS Start-End: 206-3076
agtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagctttatcagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttc

SEQ ID NO: 123881 - DNA, 3259 bp, Homo sapiens
  Payload ID: 4310
  Gene Symbol: CYLD
  Gene Name: cylindromatosis (turban tumor syndrome)
  Uniprot ID: Q9NQC7
  ENST ID: ENST00000564326
  CDS Start-End: 195-3056
ggcccaggtagcaggtttggctgcgcgggggccgcgcgtcggaggcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaa

SEQ ID NO: 123882 - DNA, 539 bp, Homo sapiens
  Payload ID: 4310
  Gene Symbol: CYLD
  Gene Name: cylindromatosis (turban tumor syndrome)
  ENST ID: ENST00000564634
  CDS Start-End: 440-539
gtcggaggtaaatactagggcggtgggtgtggggagccggggccggcccgggacgcgggctggggagccggggcgaggggcgacgccccgccgcccgagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaac

SEQ ID NO: 123883 - DNA, 3292 bp, Homo sapiens
  Payload ID: 4310
  Gene Symbol: CYLD
  Gene Name: cylindromatosis (turban tumor syndrome)
  ENST ID: ENST00000568704
  CDS Start-End: 151-2466
gcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaa

SEQ ID NO: 123884 - DNA, 1158 bp, Homo sapiens
  Payload ID: 4310
  Gene Symbol: CYLD
  Gene Name: cylindromatosis (turban tumor syndrome)
  ENST ID: ENST00000566679
  CDS Start-End: 246-1158
ggccgcgcgtcggagtttccccctttctagggtgaggatggttctacacagccacccggagttccttagttgaaaggtgcgccctgctgtgacaggcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccag

SEQ ID NO: 123885 - DNA, 777 bp, Homo sapiens
  Payload ID: 4310
  Gene Symbol: CYLD
  Gene Name: cylindromatosis (turban tumor syndrome)
  ENST ID: ENST00000569681
  CDS Start-End: 279-777
gtgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaat

SEQ ID NO: 123886 - DNA, 3513 bp, Homo sapiens
  Payload ID: 4310
  Gene Symbol: CYLD
  Gene Name: cylindromatosis (turban tumor syndrome)
  Uniprot ID: Q9NQC7
  ENST ID: ENST00000569418
  CDS Start-End: 279-3140
gtgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatgg

SEQ ID NO: 123887 - DNA, 409 bp, Homo sapiens
  Payload ID: 4310
  Gene Symbol: CYLD
  Gene Name: cylindromatosis (turban tumor syndrome)
  ENST ID: ENST00000566024
  CDS Start-End: 1-200
acggctgcatcccttgccagaatatggagttatttgctgttctctgcatagaaacaagccactatgttgcttttgtgaagtatgggaaggacgattctgcctggctcttctttgacagcatggccgatcgggatggtactgaaaacgcctttcttctgcatgtggcacagggttctgggtttggtgcaattctccattaatgaagataacatttgaattccccaaagcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggt

SEQ ID NO: 123888 - DNA, 3104 bp, Homo sapiens
  Payload ID: 4310
  Gene Symbol: CYLD
  Gene Name: cylindromatosis (turban tumor syndrome)
  ENST ID: ENST00000566206
  CDS Start-End: 251-2983
aggtagcaggtttggctgcgcgggggccgcgcgtcggagtttccccctttctagggtgaggatggttctacacagccacccggagttccttagttgaaaggcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatgctgctctctcagatccagcccccacggccttctggtgtggccctccagtagcctaagacattccctgtggcagcctcttgaacagaggcccaggccctagatcaagagttctccaccttttctcagttctctgatgcttgagggatacatcccagccccatctgtagatgtgccccc

SEQ ID NO: 123889 - DNA, 725 bp, Homo sapiens
  Payload ID: 4310
  Gene Symbol: CYLD
  Gene Name: cylindromatosis (turban tumor syndrome)
  ENST ID: ENST00000562884
  CDS Start-End: 1-315
atctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtactgaaaacgcctttcttctgcatgtggcacagggttctggtttgtagtgggacagtttgtagtgggatcgcctgttctgagtgatattttctgagaaaatcctttcaggattattctggtgacaacagtcttatatcttggattgcattaacaaccttgctagctgaactaaggaataatatgctgtgtttttttttttccttttttgagatggagtctcactctgtcacccaggctggagtgcagcagcgtgatcttggctcattgcaacctccacctctcaggttcaagcaatcctcccacctcagcctcctgagtagctgggactacacgcatatgccaccatgcctggctaatttttgtatttttagtagagatgggcttctgccatgttgcccaagctggtctcaaattcctggcctcaagtgattaaccctccttttcctctcgatgtgct

SEQ ID NO: 123890 - DNA, 1704 bp, Homo sapiens
  Payload ID: 4311
  Gene Symbol: CYP3A7-CYP3A51P
  Gene Name: CYP3A7-CYP3A51P readthrough
  ENST ID: ENST00000620220
  CDS Start-End: 10-1521
aaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatcccgctgaaattacgcttaggaggacttcttcaaccagaaaaacccattgttctaaaggttgagtcaagggatgggaccgtaagtggaacctgaatttccctaaggacttctgctttgctcttcaaaaaagctgtgacctagaacaccagagacctcaaattactttgtgaatagtaccctgaaatgaagatgggcttcatccactgtactgcataaataaccagggattctgtacatgcactgagctctctccctgtctgtgtagagtgttatact

SEQ ID NO: 123891 - DNA, 1608 bp, Homo sapiens
  Payload ID: 4311
  Gene Symbol: CYP3A7-CYP3A51P
  Gene Name: CYP3A7-CYP3A51P readthrough
  Uniprot ID: P24462
  ENST ID: ENST00000611620
  CDS Start-End: 1-1608
atggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagacctttgtagatatggagcccattcacatggactttttaagaagcttggcattccagggcccacacctctgctttttttgggaactactttgtcctaccatcagatcccgctga

SEQ ID NO: 123892 - DNA, 1196 bp, Homo sapiens
  Payload ID: 4312
  Gene Symbol: CTH
  Gene Name: cystathionine gamma-lyase
  Uniprot ID: P32929
  ENST ID: ENST00000346806
  CDS Start-End: 34-1119
ttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgag

SEQ ID NO: 123893 - DNA, 1805 bp, Homo sapiens
  Payload ID: 4312
  Gene Symbol: CTH
  Gene Name: cystathionine gamma-lyase
  Uniprot ID: P32929
  ENST ID: ENST00000370938
  CDS Start-End: 145-1362
ctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacactta

SEQ ID NO: 123894 - DNA, 2044 bp, Homo sapiens
  Payload ID: 4312
  Gene Symbol: CTH
  Gene Name: cystathionine gamma-lyase
  Uniprot ID: P32929
  ENST ID: ENST00000411986
  CDS Start-End: 199-1320
tcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttgaaaagtttactgtgaaattctactgatttaagactatacttaatatttttaaaaaaataaatcagctgggcgcggtggctcacgcatgtaatgccagcacttttggaggataaggcgggcggatcacgaggtcaggagattgagaccatcctggctagcgcagtgaaacccccatctctactaaaaatgcaaaaaaaattagacggacgtggtggcgggtgcctgtagtcccagctacttgggaggctgagg

SEQ ID NO: 123895 - DNA, 2583 bp, Homo sapiens
  Payload ID: 4313
  Gene Symbol: CBS
  Gene Name: cystathionine-beta-synthase
  Uniprot ID: P35520
  ENST ID: ENST00000352178
  CDS Start-End: 239-1894
tcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123896 - DNA, 2353 bp, Homo sapiens
  Payload ID: 4313
  Gene Symbol: CBS
  Gene Name: cystathionine-beta-synthase
  Uniprot ID: P35520
  ENST ID: ENST00000359624
  CDS Start-End: 223-1878
cacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123897 - DNA, 2453 bp, Homo sapiens
  Payload ID: 4313
  Gene Symbol: CBS
  Gene Name: cystathionine-beta-synthase
  Uniprot ID: P35520
  ENST ID: ENST00000398158
  CDS Start-End: 109-1764
ccgtctccgcctcgccgcagtcggggcagccgctcgcccctcttttccatgtatccgtccagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123898 - DNA, 2605 bp, Homo sapiens
  Payload ID: 4313
  Gene Symbol: CBS
  Gene Name: cystathionine-beta-synthase
  Uniprot ID: P35520
  ENST ID: ENST00000398165
  CDS Start-End: 261-1916
gtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123899 - DNA, 819 bp, Homo sapiens
  Payload ID: 4313
  Gene Symbol: CBS
  Gene Name: cystathionine-beta-synthase
  ENST ID: ENST00000441030
  CDS Start-End: 289-819
agttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaag

SEQ ID NO: 123900 - DNA, 573 bp, Homo sapiens
  Payload ID: 4313
  Gene Symbol: CBS
  Gene Name: cystathionine-beta-synthase
  ENST ID: ENST00000451248
  CDS Start-End: 1-448
gggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacac

SEQ ID NO: 123901 - DNA, 828 bp, Homo sapiens
  Payload ID: 4313
  Gene Symbol: CBS
  Gene Name: cystathionine-beta-synthase
  ENST ID: ENST00000430013
  CDS Start-End: 1-674
gtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgc

SEQ ID NO: 123902 - DNA, 676 bp, Homo sapiens
  Payload ID: 4313
  Gene Symbol: CBS
  Gene Name: cystathionine-beta-synthase
  ENST ID: ENST00000458223
  CDS Start-End: 1-479
gtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaaaaaaaaaaagatgcaaattccaatgtcagggtccccaaatcaagtcttcctggagcatgtccacgcttgtcaccaccgtctgtggctgctttcaagcacgtcagggctgcgtgctcataacagagacggcacggcccccaagacctaaaataccaccagctggcccttgtcggaaagtcccctggctggccctagtccattgactctgggccgagctgccagggccacagaagcctgcggcactcagggctcccagggctcccttctccaacagttgctgtgcctccgtttccccaaaatgcaaggagctgatctca

SEQ ID NO: 123903 - DNA, 2514 bp, Homo sapiens
  Payload ID: 4314
  Gene Symbol: CBSL
  Gene Name: cystathionine-beta-synthase like
  Uniprot ID: P35520
  ENST ID: ENST00000398168
  CDS Start-End: 170-1825
gcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123904 - DNA, 2353 bp, Homo sapiens
  Payload ID: 4314
  Gene Symbol: CBSL
  Gene Name: cystathionine-beta-synthase like
  Uniprot ID: P35520
  ENST ID: ENST00000618024
  CDS Start-End: 223-1878
cacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123905 - DNA, 2563 bp, Homo sapiens
  Payload ID: 4314
  Gene Symbol: CBSL
  Gene Name: cystathionine-beta-synthase like
  Uniprot ID: P35520
  ENST ID: ENST00000617706
  CDS Start-End: 223-1878
cacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcac

SEQ ID NO: 123906 - DNA, 1992 bp, Homo sapiens
  Payload ID: 4314
  Gene Symbol: CBSL
  Gene Name: cystathionine-beta-synthase like
  Uniprot ID: P35520
  ENST ID: ENST00000624934
  CDS Start-End: 170-1867
gcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacac

SEQ ID NO: 123907 - DNA, 2453 bp, Homo sapiens
  Payload ID: 4314
  Gene Symbol: CBSL
  Gene Name: cystathionine-beta-synthase like
  Uniprot ID: P35520
  ENST ID: ENST00000624406
  CDS Start-End: 109-1764
ccgtctccgcctcgccgcagtcggggcagccgctcgcccctcttttccatgtatccgtccagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactatgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 123908 - DNA, 461 bp, Homo sapiens
  Payload ID: 4315
  Gene Symbol: CST11
  Gene Name: cystatin 11
  Uniprot ID: Q9H112
  ENST ID: ENST00000377007
  CDS Start-End: 47-358
ctgaggagtacagagaacactcttcctgttcctctgcagctgaaggatgatggctgagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaa

SEQ ID NO: 123909 - DNA, 554 bp, Homo sapiens
  Payload ID: 4315
  Gene Symbol: CST11
  Gene Name: cystatin 11
  Uniprot ID: Q9H112
  ENST ID: ENST00000377009
  CDS Start-End: 35-451
gagaacactcttcctgttcctctgcagctgaaggatgatggctgagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcaggtcactgaccacctggagtatcacctgaatgtggaaatgcagtggaccacctgccaaaagccagagaccacgaactgtgtcccccaggaaagggagcttcacaagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaa

SEQ ID NO: 123910 - DNA, 890 bp, Homo sapiens
  Payload ID: 4316
  Gene Symbol: CST8
  Gene Name: cystatin 8 (cystatin-related epididymal specific)
  Uniprot ID: O60676
  ENST ID: ENST00000246012
  CDS Start-End: 358-786
ctgggccacaggcatgaactaagagtgctgaagacctaggagaaccactggtcaggtcagctcccagctccacagggagtaagaaggagctgcaggcacagcaggctgaaagtccaccaagggctgaggccacaaggcctctggggcagccacagttttcatgatcacatcatacaggactgagaagcagataacaagagtgacgctcacagggctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacaggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgatggagaaaaagtgtgaagatgcttaatggtgttttgaggcatccctccaacctctgtgactactttatccatgaaaatgaagcaatggcaggtgggaggctcttcccaatgtgctttcttcatgcatgcc

SEQ ID NO: 123911 - DNA, 630 bp, Homo sapiens
  Payload ID: 4316
  Gene Symbol: CST8
  Gene Name: cystatin 8 (cystatin-related epididymal specific)
  ENST ID: ENST00000449810
  CDS Start-End: 227-630
gcagaccaggacccacagagacccttgactgggccacaggcatgaactaagagtgctgaagacctaggagaaccactggtcagctgggctgacgctaacaggaggcagtgtgtggctcgaagattcttgaacccacagcagcagctgcggccaccccatcctgcccacagctccagccctgagacgacgaggaggagagtcgactttgcctcttgcccaagggaccatgcccaggtgccggtggctctccctgatcctcctcaccattcccctggccctggtggccaggaaagacccaaaaaagaatgagacaggggtgctgaggaaattaaaacccgtcaatgcctcaaatgccaacgtgaagcagtgtctgtggtttgccatgcaagaatacaacaaagagagcgaggacaagtatgtcttcctggtggtcaagacactgcaagcccagcttcaggtcacaaatcttctggaataccttattgatgtagaaattgcccgcagcgattgcagaaagcctttaagcactaatgaaatctgcgccattcaagaaaactccaagctgaaaaggaaattaagctgcagctttttggtaggagcacttccctggaatggtgaattcactgtgat

SEQ ID NO: 123912 - DNA, 1592 bp, Homo sapiens
  Payload ID: 4317
  Gene Symbol: CST9
  Gene Name: cystatin 9 (testatin)
  Uniprot ID: Q5W186
  ENST ID: ENST00000376971
  CDS Start-End: 13-492
ggagcctgcatcatgtcgagtccgcagaggaggaaggctatgccctgggcactgtcactgcttctcatgggcttccagctcctggtgacttatgcctggtgttctgaagaggaaatgggtggtaataataaaatagtccaggatcctatgttcctcgccacagtggagtttgccttgaacactttcaacgtgcagagcaaggaggagcatgcctacaggctgttgcgcgtcctgagttcatggagggaggatagcatggacagaaagtggcgaggtaagatggtgttctccatgaatctgcaactgcgccaaaccgtatgtaggaaatttgaagatgacattgacaactgcccttttcaagaaagcctggagctgaacaacgtaagacagggcatcagctttcctcaggtccacagctgtggatgctgcatggggtgtggtgtgggcacaggagcagctgacaaagccattccgagggacaaagggaagtgagcccacagcaggctgtaccaggctgccctgcttgtgccttagtgggaagcccagtgaggcattaagcccaggggttcactttcaggcccctggccaatctgagtttcctgattctgccctctgacaccattgcagctgcctgcacctgggccacatggccttcagaaccttctctctggtcttcctccccacttcttccctgccttctagagaaagagcctggagacaatggtgacaatgtctgtgggtacttttctcagggtttccctaccctgccctagacccaaaagtggtggaggctgagaagaagccccactgccctcgctcctaggccctgctgagctgcagcacctgctctaggggacgagctccaagcaaagcctggctctgggaaaacttcccattcttagtcaacccccttattgtaagattaacaaataggtaactaattgcctaagtctgggaactgcttccactgggacaaaacattctcctgctgctcttggatgcagggatcacaccaggacagcctggggttcccctgaggggcacgggctggaggaggaggcatggcacaagtgaccctggctaaggagggagggagcctcaaatcacgttgtagttcaggattggcctcaggctcaggctagacctgaaggccagagccacgtggcacaattgctggccccaggaatgggcaaggtggagatggaacctgtgttgagggcagatgccacaagattcccgaacctccccaaaccccgccctactgtctcttcctgtttgttccctcggaccttcagctgcttcttcactgttgaaaccatgccctggaagacatattttgaactcctgaacaagacctgctcagaggggctctcctgagtggaagccactcacatgcctggccacatgctgccccctcccccgtggacaccagctgttcccaggagttgacatatcagtggctgagcagctccgtgcatatttgttctcttattttgcaagtgtctgaggttttatgacttggcattttagaaaatcctcactgtccaggttcctcaagtagaataggtcattaaacatcagcatttgcagaa

SEQ ID NO: 123913 - DNA, 959 bp, Homo sapiens
  Payload ID: 4318
  Gene Symbol: CST9L
  Gene Name: cystatin 9-like
  Uniprot ID: Q9H4G1
  ENST ID: ENST00000376979
  CDS Start-End: 300-743
agccttcaaagctagtggcagagggtagctcccctcctgcctgtggcttgtgctggcctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctcctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaa

SEQ ID NO: 123914 - DNA, 751 bp, Homo sapiens
  Payload ID: 4319
  Gene Symbol: CSTA
  Gene Name: cystatin A (stefin A)
  Uniprot ID: P01040
  ENST ID: ENST00000264474
  CDS Start-End: 50-346
gttcactttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaagtg

SEQ ID NO: 123915 - DNA, 821 bp, Homo sapiens
  Payload ID: 4319
  Gene Symbol: CSTA
  Gene Name: cystatin A (stefin A)
  ENST ID: ENST00000479204
  CDS Start-End: 32-223
atcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggttagagttcagcacctactttagcgccaaaagatgtatttctcattttatgtaaaatattccctgatttccctaccacataattccttccttacggttgtcctaaattaagatgcccagcatgattccttccaagtggtggactctcaaatttggtagatgatgtgacaccattttttttcttgtgaattcagaaagttttattacattgattcttgatttctggaaattgtatagaaaaagatttcataacagttcagggcatgctggatttgtggctgtgctgctgcttaggtaaggagggaggatcacgtctcatctgcctgaaggtgtggggctggaccacatggtatcttgaagctgattctacctcaaagctgtatgattctctatgtctaaattaaataaattaaagtaacgactcaaatcattagctgggaaaataatttaaaccttttttgcccttcaattaatataatgtaaatactattttgtaactcaaattagatttaacttgtggcactctaggcatagtttaaaagagtggagtatttaaaatagtttaaaagttaattttatagctctgtcaaaaaattacacaatgcattgatcgagttctaat

SEQ ID NO: 123916 - DNA, 2163 bp, Homo sapiens
  Payload ID: 4320
  Gene Symbol: CSTB
  Gene Name: cystatin B (stefin B)
  Uniprot ID: P04080
  ENST ID: ENST00000291568
  CDS Start-End: 177-473
cgcgtcccttcttgcggggccaccgcgaccccgcaggggactccgaagccaaagtgcctcctccccgccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttacagattgcctcctttgttttagacttttttcttcgtctgaaccaccccgggcaggtccttcccctcgggggcatggagggcggagagactgcctggctcacacagcaagcaggtggtggacccaggattcacacctgcccactccggcccgcgttcctaaccaccactctttacatgttggtgctttgactcttaggtcctggccccaagcttcagtttctcccataaaataaaagagtgtgagtaaatccaattccagagcataactggctccagatctcagatacattcacgcactttatgctctggtacggagaggcagccacacagtgtcgtgcacgtgcagaatagcctgcagcctcactgagtgccctgtggtgcgggaggcttcccatggagccacgtgggcttctaaagggaggtatcttaggagagcgtggctgtttttaaaaacaccttctagttttcaacagggattacttcccattcatggaattggtccggtgccttcccaactgtgattctatgttaaataggacagaagagggagcatcatacatgataagagctaagactgggggtgaaagtctctgtgcaccggggtcatgatgtgaacgtgttcctgagggtgtcctgagctgcgctttgcctccgaggcgtccggcagcgtatgccagaactgcagctgcagggttcaggctgtccagatcgtgggggatctgtgaagactaaggagggatctaccagtgagtccacagagctttgaaagtgatgttaggaaattctgaatcaggccgggcgcggtggctcacacctagaatcccaacactttgggaggccaaggtgggtggatcactctgaggtcaggagttctaggccagcctgacccacatggtgaaaccctgtctctactaataataaaaaaattagctgggcgttgtggcaggcgcctgtaatcccagctacttgggaggctgagacgggaggatcacttggactcgggaggtggtgggtgcagtgagccgagatcgtacctctgcactccagcctgggtgggtgacagagtgagatcctatctcaaaaaaaaaccaaaaagaaaactgaatcatggactgtgtgtattctacactcttaacatgaactctgagactaagcttttataacatgcaaaacagaatcaagcagttttgcattgaaaggaaaacccgttgtatttcccacttgagaatttccagcggaaggcaggtgggggaggggctgtttaggggaccacgcagcgggagagccatccccaacaggaagggagcggttgtctgcaggagcagtgaccaggaactcctatggggcacctgggttgggggaagctggatttagggttagaagcttgtgtgtaaacaggaaatatcagtgtaaaacagaaaataaaatatgtaattaa

SEQ ID NO: 123917 - DNA, 873 bp, Homo sapiens
  Payload ID: 4321
  Gene Symbol: CST3
  Gene Name: cystatin C
  Uniprot ID: P01034
  ENST ID: ENST00000376925
  CDS Start-End: 165-605
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctga

SEQ ID NO: 123918 - DNA, 832 bp, Homo sapiens
  Payload ID: 4321
  Gene Symbol: CST3
  Gene Name: cystatin C
  Uniprot ID: P01034
  ENST ID: ENST00000398409
  CDS Start-End: 133-573
ggaaagggacagaggagaaggagcctgaagagtggcggcatggaggggcccgaagtggggagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 123919 - DNA, 3286 bp, Homo sapiens
  Payload ID: 4321
  Gene Symbol: CST3
  Gene Name: cystatin C
  Uniprot ID: P01034
  ENST ID: ENST00000398411
  CDS Start-End: 84-524
ctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggaccctgatgaaaagactgaggaaaatgctgcctttcctgaatggctaccaggcagggaatgatgctgggaagtgtttaccccacaggctctgtgccttctctgactgggcagctcatgctgtatgcatggaggcatcattaccaaacacacctctgaggccagcggccagcgtctgactcacaagccatgactgccccaccttcttacaacaacaatagcagtttccccgtgaggattcacccctcctcccctctcactccgcctttttccagggaagctgactctaccctttggaccacagcttggagcacttgaccctggctaagctggtcagggcagcgggtctccctcccctgaagcctcatgattggcatgaggacaacacgtgacctatgtgtggctgcccaggacccacataggcttaacggtgggattttgtttgactgtgtgataagtgggttcttccttccctgctgagtgtgaagataaaaaagacttgaggtctggggcccacttggagcctgtttgagaatgaagccaagttatgggaagcaacaaaactgaagagacagcaaggaaaccaggcctggtggtgcactcccagctattctggaggctgacgcgggaggactgcgtgagctcagcagtttgaggctgcaatgagccatgatttcactactgaactccagcctgggcaaaagagcgagaccctgtgtctcagaaaaagagagagagaaacagagagcaaggagcaggtgggttataatggagtccctgcaccaagcagagcctgatgcccgcccttgctctgaacttcctagttatgtgaaccaaccaccaggccagttgggttgggtttccagccctgtgctcttgtctgtcctcactgacagacaaaaataactcatcagtcggttctcagacccacagtcccatgacatttcttgactgtttcagaagtaatgcctcaaggaccagcttgcagaaagtggaggacctgccccctggaccttacaagtagcaggccactcttaaaaatgcaaggaccacagatgtcaccatgactgaaaaatagaggctggccctgcctctgaagatgctgcaatggacttgtgttcaaggagaaattggctgtaacttcccttattgagatataatcgggctcatcgttaagctgtggtcagccagaagtgtagctgtgcccctgggattgaaatcagcaatcaatctggacatcctttttctatcttcatgaggcacctccccagtaccaaccaaatttcttggggatcccccgggacttctcataaatggaattgatttgaactcaggaaaccctcaaataggccagaacaactcactaattaaattcatcccctcccaaaaacaaaaacaaaaacaaaaaaaaacaacacacatgataggaaaaaaattttgcaaattatatatctgatatagaacttgtattcagaacatataatgaactcttacaactcaataagactggtaacccaattaaaaattctttttaaaaaaaccaatttaaaaataaaggcaaataacctaatttttatataactcaaagtttttaaagaaacaaaccaatttaaaagttccaaaggatttgaataaacgtttttccaaagaagatatgtaaatagccaataaacgcataaaaacgtgcataacaccattagctattaggaaaaggcaaatcaaaaccacagtaaaaagcagcttcaaagccactacatggttgtggtcaaagagaccacaaataacaaattggaatctttatacatagctggtgggaatgtaaaatggtgcagctgctttggaaaacagtttcacaagttttcaaaaggttagacctaccatataacctagcaactctactcatatttatatgtcagctacaaataaaaacattaagttcaccaaaatatttacacatgaaagttcatagcatcattattaaaatcagaaaaaaatatattaaaaaaaacctcaaatgtccatcaactgacgaatggataatcaagatatagtgttagtctattcatacaatggaaaatgaacgggcataaaagagaatgacatgacccgtgctacaatgtggagcaatcttgaaaatgtgctaagtgaaagaagccagcaagccatgctgaaacaagtcagcattcatacaatatgattcaatttatatgaaatacccagaacagaaaaatgtatagagacaggctgtagattagtggttgtctagggctgggggcaatagaaggcagagtgactgctaataggaagtttccttggagggatcatgaaaatgttctaaaatcagattatacgtccatttgcacaattttgtgaatatactcggaaccactgaattgtatactttaagtgggtgaggtatgtgaaaattaaatgtcagtaaagctgtttaaaaaagtttcatcccaaagctacattttacctaaggcaaatgtttactaccgcttctctttcagtcccaaataatttccagccatatgttccagtcaagcctcgacaaaattaaacaacaccacaacttactccagttacaagccaatgtgcaaatgccccaaacttgaccataaatttaccacccaacccccatcgtctcattcccaggaaaaactaaacacaagatcaactccccttgcaagttgaagtcctgacattgaagtctaaagaaatcacagcccacaataaaattcttaaagtgtacaaacaa

SEQ ID NO: 123920 - DNA, 756 bp, Homo sapiens
  Payload ID: 4322
  Gene Symbol: CST5
  Gene Name: cystatin D
  Uniprot ID: P28325
  ENST ID: ENST00000304710
  CDS Start-End: 75-503
gggcttcctgcctcagccttctgctgctttgctctctgggagatccagctccttgctctgtgtcccagtagaacatgatgtggcccatgcacaccccactgctgctgctgactgccttgatggtggccgtggccgggagtgcctcggcccaatctaggaccttggcaggtggcatccatgccacagacctcaatgacaagagtgtgcagtgtgccctggactttgccatcagcgagtacaacaaggtcattaataaggatgagtactacagccgccctctgcaggtgatggctgcctaccagcagatcgtgggtggggtgaactactacttcaatgtgaagttcggtcgaaccacatgcaccaagtcccagcccaacttggacaactgtcccttcaatgaccagccaaaactgaaagaggaagagttctgctctttccagatcaatgaagttccctgggaggataaaatttccattctgaactacaagtgccggaaagtctaggggtctgtgcaaggcctgtcacactgaccacctcctactcccaccccctgtagtgctcccacccctggactggtggcccccaccctgggggaggtctcctcatgcgcctgcaccaggagacagacacagaaggtggcaggaggcctttgttgctcagcaggaggctctgcccttgctccttccttcttgcttctcatagccccagtgtgcagtgcacactctcccacctcctgcaattaaacagtagcattgc

SEQ ID NO: 123921 - DNA, 759 bp, Homo sapiens
  Payload ID: 4323
  Gene Symbol: CST6
  Gene Name: cystatin E/M
  Uniprot ID: Q15828
  ENST ID: ENST00000312134
  CDS Start-End: 205-654
cgtcttggcacgcgggtgcgcgccgccccctcggcctcctgggctccctgaacctcgcaggaccccggcaacttcgagccccgccccagctccaggccgcgggggcgcatcgcgggcgtcgggcggggcggcccagcgggtaaaagctgcgcggccgcaagctcggcactcacggctctgagggctccgacggcactgacggccatggcgcgttcgaacctcccgctggcgctgggcctggccctggtcgcattctgcctcctggcgctgccacgcgacgcccgggcccggccgcaggagcgcatggtcggagaactccgggacctgtcgcccgacgacccgcaggtgcagaaggcggcgcaggcggccgtggccagctacaacatgggcagcaacagcatctactacttccgagacacgcacatcatcaaggcgcagagccagctggtggccggcatcaagtacttcctgacgatggagatggggagcacagactgccgcaagaccagggtcactggagaccacgtcgacctcaccacttgccccctggcagcaggggcgcagcaggagaagctgcgctgtgactttgaggtccttgtggttccctggcagaactcctctcagctcctaaagcacaactgtgtgcagatgtgataagtccccgagggcgaaggccattgggtttggggccatggtggagggcacttcaggtccgtgggccgtatctgtcacaataaatggccagtgctgcttcttgca

SEQ ID NO: 123922 - DNA, 930 bp, Homo sapiens
  Payload ID: 4324
  Gene Symbol: CST7
  Gene Name: cystatin F (leukocystatin)
  Uniprot ID: O76096
  ENST ID: ENST00000480798
  CDS Start-End: 277-714
gctgtggccctggcacctgcccctgggctgggacagcccactgttccatgctgcccaagaaggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcacctcctaacagattaaatagatcacatttgcttctaaaattaa

SEQ ID NO: 123923 - DNA, 751 bp, Homo sapiens
  Payload ID: 4325
  Gene Symbol: CST4
  Gene Name: cystatin S
  Uniprot ID: P01036
  ENST ID: ENST00000217423
  CDS Start-End: 72-497
gggctccctgcctcgggctctcaccctcctctcctgcagctccagctttgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggaggacagaatgtccctggtgaattccaggtgtcaagaagcctaggggtctgtgccaggccagtcacaccgaccaccacccactcccacccactgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 123924 - DNA, 748 bp, Homo sapiens
  Payload ID: 4326
  Gene Symbol: CST2
  Gene Name: cystatin SA
  Uniprot ID: P09228
  ENST ID: ENST00000304725
  CDS Start-End: 72-497
gggatccccgcctcaggctctcaacctcctctcctgcagctccagctctgtgctctgcctccgaggagaccatggcctggcccctgtgcaccctgctgctcctgctggccacccaggctgtggccctggcctggagcccccaggaggaggacaggataatcgagggtggcatctatgatgcagacctcaatgatgagcgggtacagcgtgcccttcactttgtcatcagcgagtataacaaggccactgaagatgagtactacagacgcctgctgcgggtgctacgagccagggagcagatcgtgggcggggtgaattacttcttcgacatagaggtgggccgaaccatatgtaccaagtcccagcccaacttggacacctgtgccttccatgaacagccagaactgcagaagaaacagttgtgctctttccagatctacgaagttccctgggaggacagaatgtccctggtgaattccaggtgtcaagaagcctagggatctgtgccagggagtcacactgaccacctcctactcccaccccttgtagtgctcccacccctggactggtggcccccaccctgtgggaggtctccccatgcacctgcagcaggagaagacagagaaggctgcaggaggcctttgttgctcagcaggggactctgccctccctccttccttttgcttctcatagccctggtacatggtacacacacccccacctcctgcaattaaacagtagcatcacc

SEQ ID NO: 123925 - DNA, 760 bp, Homo sapiens
  Payload ID: 4327
  Gene Symbol: CST1
  Gene Name: cystatin SN
  Uniprot ID: P01037
  ENST ID: ENST00000304749
  CDS Start-End: 72-497
gggctccctgcctcgggctctcaccctcctctcctgcagctccagctttgtgctctgcctctgaggagaccatggcccagtatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacacccccccacctcctgcaattaaacagtagcatcgcctccctctga

SEQ ID NO: 123926 - DNA, 655 bp, Homo sapiens
  Payload ID: 4327
  Gene Symbol: CST1
  Gene Name: cystatin SN
  Uniprot ID: P01037
  ENST ID: ENST00000398402
  CDS Start-End: 145-570
caggaagtcacatagctttcacagtcaaaggaccagtgtcacctctgtggagacctgggtgactcaagcttgggagcactggggaagagaggcatggctcggggaggctgcactccagctttgtgctctgcctctgaggagaccatggcccagtatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccc

SEQ ID NO: 123927 - DNA, 510 bp, Homo sapiens
  Payload ID: 4328
  Gene Symbol: CSTL1
  Gene Name: cystatin-like 1
  Uniprot ID: Q9H114
  ENST ID: ENST00000246020
  CDS Start-End: 21-458
aagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagctgacgacgggagtggagtatatagtcactgtgaagattggctggaccaaatgcaagaggaatgacacgagcaattcttcctgccccctgcaaagcaagaagctgagaaagagtttaatttgcgagtctttgatatacaccatgccctggataaactatttccagctctggaacaattcctgtctggaggccgagcatgtgggcagaaacctcagatgagggctcatatgattgagttgtgcactggctgttattaaactgtaaaggatca

SEQ ID NO: 123928 - DNA, 736 bp, Homo sapiens
  Payload ID: 4328
  Gene Symbol: CSTL1
  Gene Name: cystatin-like 1
  Uniprot ID: Q9H114
  ENST ID: ENST00000347397
  CDS Start-End: 247-684
agggggatcctgcaagcagaaatctgtggtgggcgggcggcaggtgagcaaggagaacgtgtctgtaaaggaagcacagggaacaggtggtggctttgtaagacagttggaacccaaggaaggcaggccatcccccaggaaagcctatgttggtgagggttatgatgggagaatgagtgaactgcagcctggcaccaccacaccctggaaggtgcagttgggaagaaagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagctgacgacgggagtggagtatatagtcactgtgaagattggctggaccaaatgcaagaggaatgacacgagcaattcttcctgccccctgcaaagcaagaagctgagaaagagtttaatttgcgagtctttgatatacaccatgccctggataaactatttccagctctggaacaattcctgtctggaggccgagcatgtgggcagaaacctcagatgagggctcatatgattgagttgtgcactggctgttattaaactgtaaaggatca

SEQ ID NO: 123929 - DNA, 477 bp, Homo sapiens
  Payload ID: 4328
  Gene Symbol: CSTL1
  Gene Name: cystatin-like 1
  ENST ID: ENST00000619238
  CDS Start-End: 367-477
agggggatcctgcaagcagaaatctgtggtgggcgggcggcaggtgagcaaggagaacgtgtctgtaaaggaagcacagggaacaggtggtggctttgtaagacagttggaacccaaggaaggcaggccatcccccaggaaagcctatgttggtgagggttatgatgggagaatgagtgaactgcagcctggcaccaccacaccctggaaggtgcagttgggaagaaagtttctgaggctgtagacatggggatcggatgctggagaaaccccctgctgctgctgattgccctggtcctgtcagccaagctgggtcacttccaaaggtgggagggcttccagcagaagctcatgagcaagaagaacatgaattcaacactcaacttcttcattcaatcctacaacaatgccagcaacgacacctacttatatcgagtccagaggctaattcgaagtcagatgcagcaggtacattgt

SEQ ID NO: 123930 - DNA, 1952 bp, Homo sapiens
  Payload ID: 4329
  Gene Symbol: CSRP1
  Gene Name: cysteine and glycine-rich protein 1
  Uniprot ID: P21291
  ENST ID: ENST00000340006
  CDS Start-End: 192-773
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagacc

SEQ ID NO: 123931 - DNA, 2129 bp, Homo sapiens
  Payload ID: 4329
  Gene Symbol: CSRP1
  Gene Name: cysteine and glycine-rich protein 1
  Uniprot ID: P21291
  ENST ID: ENST00000367306
  CDS Start-End: 365-946
ggcttgttcctgtttgcatgacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 123932 - DNA, 890 bp, Homo sapiens
  Payload ID: 4329
  Gene Symbol: CSRP1
  Gene Name: cysteine and glycine-rich protein 1
  ENST ID: ENST00000531916
  CDS Start-End: 365-826
ggcttgttcctgtttgcatgacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggaccccaaagtcaggatgttgtttgatcttctcaaacatctagttccctgcttgatgggaggatcctaatgaaatacctgaaacatatattggcatttatcaatggctcaaatcttcatttatctctggcctt

SEQ ID NO: 123933 - DNA, 1469 bp, Homo sapiens
  Payload ID: 4329
  Gene Symbol: CSRP1
  Gene Name: cysteine and glycine-rich protein 1
  Uniprot ID: P21291
  ENST ID: ENST00000532460
  CDS Start-End: 154-735
atcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctg

SEQ ID NO: 123934 - DNA, 574 bp, Homo sapiens
  Payload ID: 4329
  Gene Symbol: CSRP1
  Gene Name: cysteine and glycine-rich protein 1
  ENST ID: ENST00000526723
  CDS Start-End: 56-538
agccgccacttccgagagcgcctgccgcccctgcgccgccgagccagctgccagaatgccgaactggggaggaggcaagaaatgtggggtgtgtcagaagacggtttactttgccgaagagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgc

SEQ ID NO: 123935 - DNA, 1149 bp, Homo sapiens
  Payload ID: 4329
  Gene Symbol: CSRP1
  Gene Name: cysteine and glycine-rich protein 1
  Uniprot ID: P21291
  ENST ID: ENST00000533432
  CDS Start-End: 218-799
gtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacat

SEQ ID NO: 123936 - DNA, 582 bp, Homo sapiens
  Payload ID: 4329
  Gene Symbol: CSRP1
  Gene Name: cysteine and glycine-rich protein 1
  ENST ID: ENST00000524951
  CDS Start-End: 124-582
agccgccacttccgagagcgcctgccgcccctgcgccgccgagccagctgccagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtc

SEQ ID NO: 123937 - DNA, 582 bp, Homo sapiens
  Payload ID: 4329
  Gene Symbol: CSRP1
  Gene Name: cysteine and glycine-rich protein 1
  ENST ID: ENST00000526256
  CDS Start-End: 56-109
agccgccacttccgagagcgcctgccgcccctgcgccgccgagccagctgccagaatgccgaactggggaggaggcaagaaatctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgag

SEQ ID NO: 123938 - DNA, 943 bp, Homo sapiens
  Payload ID: 4330
  Gene Symbol: CSRP2
  Gene Name: cysteine and glycine-rich protein 2
  Uniprot ID: Q16527
  ENST ID: ENST00000311083
  CDS Start-End: 125-706
caccgagcgctctttaaaaggcaccggcgcgcgcttcgcctgggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttga

SEQ ID NO: 123939 - DNA, 910 bp, Homo sapiens
  Payload ID: 4330
  Gene Symbol: CSRP2
  Gene Name: cysteine and glycine-rich protein 2
  ENST ID: ENST00000552330
  CDS Start-End: 56-787
ccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagcattccaagctgtatcaaggagtcgtgttctcaaaagcaagtgatttgtatttacttcaatttcacagcaccttggagaccggatgtcatgaaattaaatggtagagaaatgtgctgtgtgaatcatgagaggtgtttctcatgtgcaattgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtac

SEQ ID NO: 123940 - DNA, 754 bp, Homo sapiens
  Payload ID: 4330
  Gene Symbol: CSRP2
  Gene Name: cysteine and glycine-rich protein 2
  Uniprot ID: Q16527
  ENST ID: ENST00000546966
  CDS Start-End: 63-644
gcctgggatctcggactccctggaccctccctccagcccagcctcgctagctccgcctgcgaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgta

SEQ ID NO: 123941 - DNA, 632 bp, Homo sapiens
  Payload ID: 4330
  Gene Symbol: CSRP2
  Gene Name: cysteine and glycine-rich protein 2
  ENST ID: ENST00000547435
  CDS Start-End: 50-613
cagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggtaaaattcatttcagttactgctgtccatatgaatattccacactggttcttgtttaatgaaatgtcactggcatta

SEQ ID NO: 123942 - DNA, 1342 bp, Homo sapiens
  Payload ID: 4331
  Gene Symbol: CSRP3
  Gene Name: cysteine and glycine-rich protein 3 (cardiac LIM protein)
  Uniprot ID: P50461
  ENST ID: ENST00000265968
  CDS Start-End: 118-702
caggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgtattataaatga

SEQ ID NO: 123943 - DNA, 1456 bp, Homo sapiens
  Payload ID: 4331
  Gene Symbol: CSRP3
  Gene Name: cysteine and glycine-rich protein 3 (cardiac LIM protein)
  Uniprot ID: P50461
  ENST ID: ENST00000533783
  CDS Start-End: 242-826
gcagtgagccgagatcgcgccactacactccagactgggcgacagagccagactccgtctcaaaaaaaaaaaaaaaaaaagagagagagcaccttaggaatcatctgcctcacacgaatattctcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgta

SEQ ID NO: 123944 - DNA, 2654 bp, Homo sapiens
  Payload ID: 4332
  Gene Symbol: CHORDC1
  Gene Name: cysteine and histidine-rich domain (CHORD) containing 1
  Uniprot ID: Q9UHD1
  ENST ID: ENST00000320585
  CDS Start-End: 411-1409
atgagagggcggggcggccactttgctgcaggagatacccaaagccagttagcactgaggaagtcagaagagaattgtcagtctctcggacaccttcattttctgccccggaaatttctcctccgctgttgtctgggctccacttccgacccccagttgctaccagctgtagtccgacctatcgtggcccgggctagtgccagcctcccgccgctacctccgcctcgtcccttctcctctgcgcctgcgcgaccggaaaattcgcgaaggttcctgaaacgcaacggatcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttggagtttttttttaaagtcatgaagagcttcacaattctagtgatacaatgttgactatatattgtactttatattaaatataggtaatacagaattagatcgtttggataggttttgagttagtgcagaactcaagaagaaaaattaggaaatattctgaaggccagaactctggaagaacttagaaagtttgggaataaattaaacttatgtagatttaaaattaaaaggggtttatttcccaaaccccttgagtcttttcttttccttggtatttatggaattc

SEQ ID NO: 123945 - DNA, 2003 bp, Homo sapiens
  Payload ID: 4332
  Gene Symbol: CHORDC1
  Gene Name: cysteine and histidine-rich domain (CHORD) containing 1
  Uniprot ID: Q9UHD1
  ENST ID: ENST00000457199
  CDS Start-End: 106-1047
tagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgtt

SEQ ID NO: 123946 - DNA, 564 bp, Homo sapiens
  Payload ID: 4332
  Gene Symbol: CHORDC1
  Gene Name: cysteine and histidine-rich domain (CHORD) containing 1
  ENST ID: ENST00000530765
  CDS Start-End: 124-474
atcgtttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtcttcttcgtgctacacttgagtactaaattgttttagaagcaaactacaggacttaaaaaaaggtgatttttttttttttttttggctgcaagtaggcacttattgtaat

SEQ ID NO: 123947 - DNA, 809 bp, Homo sapiens
  Payload ID: 4332
  Gene Symbol: CHORDC1
  Gene Name: cysteine and histidine-rich domain (CHORD) containing 1
  ENST ID: ENST00000529402
  CDS Start-End: 119-472
ttccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacggtaagaggaacgcgccgccagccctccctcccctccacctcatcagcaggggaggccctttgggccggagggtgtccgcggatctcctgcagccgtcctcgcgcggccccaggtccatgcccctcctgggcctcccttggctgcccgcgcagcccgccggccgcccctctgttgcgccgcgttcccttggcgagcgcccggccccggcgcctgactgtcctctgccactgcggagagagacgctcccatggatccacgtgtttcccccgtcgtccccgcactccttttaagtcgcctggaatttagaacgaacacgtttctcctctggccctccagtctctggggaagcaaaaattaacgagatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaag

SEQ ID NO: 123948 - DNA, 575 bp, Homo sapiens
  Payload ID: 4332
  Gene Symbol: CHORDC1
  Gene Name: cysteine and histidine-rich domain (CHORD) containing 1
  ENST ID: ENST00000533062
  CDS Start-End: 118-237
tccggaagccggtagccgcctcagtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagtcctagactttccaagattattggatttcacagtccagaagatttcagacaaaatgcgtatacatcaatacagggatactagttgaccaaggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtatactttatacagttacatatttttgtcacacttgaa

SEQ ID NO: 123949 - DNA, 1698 bp, Homo sapiens
  Payload ID: 4332
  Gene Symbol: CHORDC1
  Gene Name: cysteine and histidine-rich domain (CHORD) containing 1
  ENST ID: ENST00000529987
  CDS Start-End: 303-737
cctcaaaagaagaagaaatgtgtcatatatcaatttggggatataagcaaatcctagtcacagtcgttttctaaaaagtattgttttctggaaaaacctagtttttaagaatgatgccacagcgaagttctattttaactttttaatttgatttttttttctttgttacagaagaagacaatgatgaaattaagattgggacctcatgtaagaatggagggtgttcaaagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctgcagttttttctatgtgggatgattacttttttaaggaggattaattctgaggtagtatagtaactaaaggggaatatatgaattgtttaacaaattagaatttgtttacaactacttgaatttttaaattatgtcaaaacttacattacttgccaagcagtatgatgttataggaaacataaataagattacagaggtatcaatttggttaaaattcaccattttataagactaagcaataatcttaacaacctctttcctgaatatttaaatgtgtttgtatggtgttatgactaattgttactgatttagagactaagccctcttaaaacctttagttaaatataaaaagaaattatatatatcttgcctccctgatggaaaactatataaaattgtagacttaaaaggtttgtggaaatacattaggatatcagaaaactaaatatatggagttgctttatgactattacatgttaaataaaaatagcttaattgttttgga

SEQ ID NO: 123950 - DNA, 566 bp, Homo sapiens
  Payload ID: 4332
  Gene Symbol: CHORDC1
  Gene Name: cysteine and histidine-rich domain (CHORD) containing 1
  ENST ID: ENST00000533772
  CDS Start-End: 96-458
agtcgtcagaccggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaaggtttcaaaattctccagcccagatgaaccaatgacaaatttggaattaaaaatatctgcctccctaaaacaagcacttgataaacttaaactgtcatcagggaatgaagaaaataagaaagaagacaatgatgaaattaaga

SEQ ID NO: 123951 - DNA, 4805 bp, Homo sapiens
  Payload ID: 4332
  Gene Symbol: CHORDC1
  Gene Name: cysteine and histidine-rich domain (CHORD) containing 1
  ENST ID: ENST00000529726
  CDS Start-End: 3915-4349
agtgcgtgtagaatgaatgatagaatttgaaagtacagaaagtacagatggttccgaacttaccatggtgtaacttaagatttttttgacttaacaatggtattatcaggctataaccacattgtaagcaaaggagcatctgcctgtattagcaggatttgctaatggattcgatgtgaagggaattcaagcatctgggtgattggtgacaccattaaccaacaaggtgaaaatggggtgggggcaggtttatactttttcctcatgttaaattttagatcacttaaggaatggagatacaattgtatttacatgtatatgaggtagaagtagtagataaaagggaattagtaattactggattggggaaggcagtgcaaatggtagggtaatagaggaagatcaaggagaaggtatcagatgtgttttgaaaagtgaatgacagggaaaacagagaaagggtatttcaagcgtaagtaatagcacaagtatagagaaaattatgtaatggtacaaatttgctgctgtggaattgagattaatagagataagtagacctggccagatcctaaaagggtttagtgatgcagggaagttagattgtacgttagagtgtggaggccattgaaattgaagaattttttagtctttttcattgaaatataacattgaagtttgttaaaggatatacaaatataaatttgtagctcaagggattttcacaaaattaaacacaccagcaatgcagagcactccttatgtgttttctcattcattatcttcctcaaatgtttttctgtcagtcaacatatgttttttctgtttctgagtttaatgtaaaaataaccatagaatatgtacttgtttttgtcgtcttctgcataataatgcttgttttatttatctttgttgcatgtagctttagttttgtttttttatttctttaaggtatgtcattatttgaatgtgccacaactaatttctactttatattgtcctttaattttaaaaaattgtttttaataatgctattatgaacattctttttgagatggagtttcactcttgtaacccaccctggagtacaatggtaggctctcggctcactacaacctccgcctcccgggttcaagcgattcttctgtttcagcctcctgagtagctgggtttacaggtgcccaccacgcctgactaatttttgtatttttactagagacaaggtttcaccatgttggccaggctggtctcaaactcctgaacctcaggtgatccacccgcctcggcctcccaaagtgctggaattacaggcgtgaagccaccgcagccggcctattatgaacattcttgtgcatgacttttgtgacacatatacacatttccatttctagtattttggatttttttttttaaattttggcatatgtgcattatacttatcagttagttcagcatccctaatctgaaatgctccaatgagcattttctttaactgtcatgttggctctcaaaaagttaacagatttttggagcatttgagattttggattaggtatgcccacctgtatatctttagcattaacagatacttccacatagttttccaaggtggttgtatttgtttacgtttctaccagcagtatgtgaggctagttcaacttgtcctatggtttcttaacattttgttatacgagttttttttgtttttttttttttttttgtattttaaccattctagtgtgtgtatagtgttttgtcatggttttgatttgtacttccctaatgatgactgcttttttgtatgtttattagccatttgtatatcctcttgtgaagtgtgcagaatcttttacctatctctaatgtctcttgcttaccagtttgtaagaattctttatatattttagctgtgactcttatcagaaattctatgctttttcactgtcttaatgacgactttgataaactttttatcaaattgctttttaacaaaatccaatttgtccatcattttgtttatgactagtgctttccatgttctatttaagaaatcgttgcttacttcagggctgtgagtgttttctcatatggaggcacatttaaatatgtaaatgacctggaactgattattgtataaggtgtgacatggatgtaattaaagaactttaaacaaaagggtgatagtaatttgataattagtagaaaatagaagtcgaaggctgagaaatagtagaaacctgttagtatagtctgattgcttaaaatctgctagcttatgaggaagattaacaaattaatatattcaagtcaaattgatgagatttcattatagactgcctatgggtggagggagaggagatgctgaagaggaacgaatggattttgctttgagaaactgagtctgtacggtgccatcaaataatatggggaaaagaatggactgtgggggcaatagcattaagtttagtagatgctaacatactgagttttatgttcttgtgaaatatcttaaggagaaatacacatctaatactgtactttggatttataaaagataaacacagaattttattttctgtttgtaggtagtgctataaatacaaaaatagaaaatatactactggctacatccatgttttattaacataattttttgtgaattcatctgtagagcctccatctacagcagcaatggggcccggatcttccagacaaaccctggatatatatataggtctgcagctcattttaccctttatagggataagaaatcaccatcactctagaacttccagaattgcttattagatttctcatattatttgacaatacttacatggagtttactgtacacataagtcatgcagtaactgtatttttattgagagtattaatcccttggtttcaacattgtttttgaaattagtaactaagtaagtacttgaatatgattggatgggatctcatactcaaaaggctgaaagcatcttaatatgactttctcaaaggaacctaaaacttaaccaagtccaaaagggaatcatttttcattttttaacagaatggcgtgggatggatttatgaattttctaggtaattgtcatttaagtattttgcaaagttcgtagaggtcaccaatactgcaaatatgtatgagatgtaactgtaagatacgcagctaattttttttctctttgtttcctttttagacataccagggtctagagagtctagaagaagtctgtgtatatcattctggagtacctattttccatgaggggtaacttatgcatgacttattaaaatagtttatggtagaatttagaaagttaaacctttctgtctttaaacattgtttgccatgcagtgttattaggcattttacttacattgccattaacatcttcacaatagcctacacaaacacaggggtttgtatgttgtgtgtttatacatgagaaaacagaaacaaggttacagttcttaagtggtcattgtgatataaactgcctgtttttcttcatattctgtatttaaaagtgatgctatttgggctaaatgttttgtttgaaggactgtcctacacattgcagggcatttagaattttgggccctggggcactaagacaacattatcccaagacgacccatacttttccgcatcctgcagttgagagcctctcttctgtattatgctctagtttatagaaatgcagcactgtgtaaaaatcttccactctgtttccacattcttcctgatatactgtacattcatttttagtaacttagacacttgtaaaatgctagagtttgtacacttactggcttattaaaaatcagatttatccctaaaatacttgtggatttaattggttgtgagattttatttctgaagtttttctgtgataatttaaaggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagattgagtgggagatggaaggaaggctattacattatttccgaatttttaatactgtgtgaagtggtggcttgctgctgtaatcttttgttttgttgttgtgttactgaatgtggcatttcagggttaacattaggttcttaaaagccaaagtcagtttgtctttttgtgcctctcatctttcttttgtgttatgtaagattgattattcatttctccctactggtaggaaccatagttgtgtcctatacttgaagaggctggaaagtagcccataaccataattgcagtatttctttgtatttctctgttaagcaaagaaatattaaggaacattttttttatgtttttgtattattccataattagtaaagcaagatgaaatgtcaaattttaatcagttttttcatggatttgtgttcttacagtacttgaaaatatttaaggaagagatgaagctctg

SEQ ID NO: 123952 - DNA, 1136 bp, Homo sapiens
  Payload ID: 4332
  Gene Symbol: CHORDC1
  Gene Name: cysteine and histidine-rich domain (CHORD) containing 1
  ENST ID: ENST00000525317
  CDS Start-End: 77-631
gcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaagggttggtcttgctgtaagagaagaacaactgatttttctgatttcttaagcattgtaggctgtacaaaaggtagacataatagtgagaagccacctgagccagtcaaacctgaagtcaagactactgagaagaaggagctatgtgaattaaaacccaaatttcaggaacacatcattcaagcccctaagccagtagaagcaataaaaagaccaagcccagatgaaccaatgacaaatttggaattaaaaatatctgcctccctaaaacaagcacttgataaacttaaactgtcatcagggaatgaagaaaataagaaagaagaagacaatgatgaaattaagattgggacctcatgtaagaatggagggtgttcaaagagcctccatctacagcagcaatggggcccggatcttccagacaaaccctggatatatatatagacataccagggtctagagagtctagaagaagtctgtgtatatcattctggagtacctattttccatgaggggatgaaatactggagctgttgtagaagaaaaacttctgattttaatacattcttagcccaagagggctgtacaaaagggaaacacatgtggactaaaaaagatgctgggaaaaaagttgttccatgtagacatgactggcatcagactggaggtgaagttaccatttcagtatatgctaaaaactcacttccagaacttagccgagtagaagcaaatagcacattgttaaatgtgcatattgtatttgaaggagagaaggaatttgatcaaaatgtgaaattatggggtgtgattgatgtaaagcgaagttatgtaactatgactgcaacaaagattgaaatcactatgagaaaagctgaaccgatgcagtgggcaagccttgaactgcctgcagctaaaaagcaggaaaaacaaaaagatgccacaacagatt

SEQ ID NO: 123953 - DNA, 2070 bp, Homo sapiens
  Payload ID: 4333
  Gene Symbol: CCBL2
  Gene Name: cysteine conjugate-beta lyase 2
  Uniprot ID: Q6YP21
  ENST ID: ENST00000260508
  CDS Start-End: 339-1703
cgcgatcgcggcggaccccaccgtcatcgcgcgccgtgagtcacactccacagccaatccctggccacatccgggctcgcccccgccccgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgca

SEQ ID NO: 123954 - DNA, 1263 bp, Homo sapiens
  Payload ID: 4333
  Gene Symbol: CCBL2
  Gene Name: cysteine conjugate-beta lyase 2
  ENST ID: ENST00000370485
  CDS Start-End: 66-590
aagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaaactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatg

SEQ ID NO: 123955 - DNA, 1019 bp, Homo sapiens
  Payload ID: 4333
  Gene Symbol: CCBL2
  Gene Name: cysteine conjugate-beta lyase 2
  ENST ID: ENST00000370486
  CDS Start-End: 233-1019
ccaccccttccctcctccatttccatccattccgcgatcgcggcggaccccaccgtcatcgcgcgcccctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatag

SEQ ID NO: 123956 - DNA, 1868 bp, Homo sapiens
  Payload ID: 4333
  Gene Symbol: CCBL2
  Gene Name: cysteine conjugate-beta lyase 2
  Uniprot ID: Q6YP21
  ENST ID: ENST00000370491
  CDS Start-End: 196-1458
aaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgactttagccggt

SEQ ID NO: 123957 - DNA, 1903 bp, Homo sapiens
  Payload ID: 4334
  Gene Symbol: CCBL1
  Gene Name: cysteine conjugate-beta lyase, cytoplasmic
  Uniprot ID: Q16773
  ENST ID: ENST00000302586
  CDS Start-End: 164-1432
ttctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatcctta

SEQ ID NO: 123958 - DNA, 1623 bp, Homo sapiens
  Payload ID: 4334
  Gene Symbol: CCBL1
  Gene Name: cysteine conjugate-beta lyase, cytoplasmic
  Uniprot ID: Q16773
  ENST ID: ENST00000320665
  CDS Start-End: 40-1158
ttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaaga

SEQ ID NO: 123959 - DNA, 847 bp, Homo sapiens
  Payload ID: 4334
  Gene Symbol: CCBL1
  Gene Name: cysteine conjugate-beta lyase, cytoplasmic
  ENST ID: ENST00000451800
  CDS Start-End: 95-847
cacaggggtgcctgggagggggctcgcgcgccgcggagccggcgagaaggtggtgccccggagactccgggcactggggagcccagagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgcc

SEQ ID NO: 123960 - DNA, 477 bp, Homo sapiens
  Payload ID: 4334
  Gene Symbol: CCBL1
  Gene Name: cysteine conjugate-beta lyase, cytoplasmic
  ENST ID: ENST00000427720
  CDS Start-End: 1-477
gccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtctcactctgttatccaggctggagtgcaatggtgcgatcatggtccactgcagccttgaccctgccagtctcaagtggtcctcccacctcagcctctggagtaactgggactacaggctggtctcagagctggttggaaagttccttctttgatccaaaaaaaaaaaaaatcatttggggttacccaccactgacgaagatcctggcaagtttctttggggagctgctgggtcaggagatagacccgctcaggaatgtgctggtgactgtt

SEQ ID NO: 123961 - DNA, 2487 bp, Homo sapiens
  Payload ID: 4334
  Gene Symbol: CCBL1
  Gene Name: cysteine conjugate-beta lyase, cytoplasmic
  ENST ID: ENST00000436267
  CDS Start-End: 295-1845
gtcgccatctttatgaggagaattctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggagctgtgtgtgggggacccaagtcctgagctcggaggcattttctggccagggctgtttcctcccttctcccctgcctctggaaaagtctgcagtgccccaaggctctgggaggcatgttcaggactgcagcagccatctctgtgcacctggtggggccccttcagggaaggaaggctggagccccactcacttggttcttgcaccagactcaggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttattgacggcttctctctgcttcacactcatgctgatggctgatctaacttgtgaagaatgcccagaagaacctcagacacccccacaactttgtacaaatggttactgtagtcacatagtggcacaaccaggcctagcacccaaggccctcaaatgaattcctcactattaa

SEQ ID NO: 123962 - DNA, 736 bp, Homo sapiens
  Payload ID: 4334
  Gene Symbol: CCBL1
  Gene Name: cysteine conjugate-beta lyase, cytoplasmic
  ENST ID: ENST00000416084
  CDS Start-End: 185-736
ggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaac

SEQ ID NO: 123963 - DNA, 1860 bp, Homo sapiens
  Payload ID: 4335
  Gene Symbol: CDO1
  Gene Name: cysteine dioxygenase type 1
  Uniprot ID: Q16878
  ENST ID: ENST00000250535
  CDS Start-End: 558-1160
agcggcggaggtggagcggggagaggcgttaggccgggcggctaaaacgcgccgttaaagtgggggagagattgcgcggagcccacgcgatccctgggacgccggagacaacggggctcttgggaaggcgcggagcccggggaagccggggatgtgcgcgtgagccgtgcccgcagggtctccccgcctccgccacctttcttgggtggctctccgcctcgtcctccctccgagggccgttggtacattcctagtgactccaagcgcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaa

SEQ ID NO: 123964 - DNA, 5912 bp, Homo sapiens
  Payload ID: 4336
  Gene Symbol: CRIM1
  Gene Name: cysteine rich transmembrane BMP regulator 1 (chordin-like)
  Uniprot ID: Q9NZV1
  ENST ID: ENST00000280527
  CDS Start-End: 368-3478
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcaccgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatca

SEQ ID NO: 123965 - DNA, 874 bp, Homo sapiens
  Payload ID: 4336
  Gene Symbol: CRIM1
  Gene Name: cysteine rich transmembrane BMP regulator 1 (chordin-like)
  ENST ID: ENST00000413985
  CDS Start-End: 1-528
gccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcataggaggccaaacctgattttgtaccctctagtggtcaaggatatgggggaagaccccatcacaagagggcccacctgataagaaccctctggagactgctggcagagtcttcttaacaggacttggactgtgaccagataaaacatcttctataggtgcagaaactggccaatctggaaggtccaatggcttctacgttaaggttttcttaacaagatggtataccccgacttttacatggattgcttcttttaagtcctaaaagaagttgtatttcttcctccttatttgggccaccttgatctttagttgtttctgcctgccttttaaaatgacatttttatatttccaaaatgatttat

SEQ ID NO: 123966 - DNA, 667 bp, Homo sapiens
  Payload ID: 4336
  Gene Symbol: CRIM1
  Gene Name: cysteine rich transmembrane BMP regulator 1 (chordin-like)
  ENST ID: ENST00000426856
  CDS Start-End: 1-667
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatg

SEQ ID NO: 123967 - DNA, 700 bp, Homo sapiens
  Payload ID: 4336
  Gene Symbol: CRIM1
  Gene Name: cysteine rich transmembrane BMP regulator 1 (chordin-like)
  ENST ID: ENST00000428774
  CDS Start-End: 1-167
gcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagctgcggggtattgaatttgaggctgctctcagcattactgctcatctcaaagaggaacaaatggtcccccaaatggtccagatgcaacagtagggaaaggagtgccaccattcattctgaggtgcctgggccatactctggatgaagctcacagctctaacgtaaggcggtaagtcattttttttttaaacttaaggaagttaatttgaaagtttatgctgatgccatttcatatgacagagactaaagggtatacgtccttgtgttctcttggtggggactgctgtcctaaaggtaaaagattttgatccagaggttggattgttcctcgtgtggcaacagtcctctgacctcagtcattttcaaagtctaatgtctttttggctaacaaaagacatcaagctagagattaaaatttgcagaagatgggagtttttttgttgttttcggttttttttttttttttttttgagacggagtctcactctgtcacccaggctggagtgcaggtgatcatatctacaaaggtgacaagaacatgaacctg

SEQ ID NO: 123968 - DNA, 698 bp, Homo sapiens
  Payload ID: 4336
  Gene Symbol: CRIM1
  Gene Name: cysteine rich transmembrane BMP regulator 1 (chordin-like)
  ENST ID: ENST00000619935
  CDS Start-End: 368-698
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 123969 - DNA, 181 bp, Homo sapiens
  Payload ID: 4336
  Gene Symbol: CRIM1
  Gene Name: cysteine rich transmembrane BMP regulator 1 (chordin-like)
  ENST ID: ENST00000613124
  CDS Start-End: 1-181
tgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 123970 - DNA, 153 bp, Homo sapiens
  Payload ID: 4336
  Gene Symbol: CRIM1
  Gene Name: cysteine rich transmembrane BMP regulator 1 (chordin-like)
  ENST ID: ENST00000619072
  CDS Start-End: 1-153
gcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaag

SEQ ID NO: 123971 - DNA, 2645 bp, Homo sapiens
  Payload ID: 4337
  Gene Symbol: CSAD
  Gene Name: cysteine sulfinic acid decarboxylase
  Uniprot ID: Q9Y600
  ENST ID: ENST00000267085
  CDS Start-End: 235-1797
gcttggggacgcacggagaggtgcagctgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaaataataaagttaaaatttcaactgca

SEQ ID NO: 123972 - DNA, 2086 bp, Homo sapiens
  Payload ID: 4337
  Gene Symbol: CSAD
  Gene Name: cysteine sulfinic acid decarboxylase
  ENST ID: ENST00000379843
  CDS Start-End: 55-858
ctgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccatgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaa

SEQ ID NO: 123973 - DNA, 1962 bp, Homo sapiens
  Payload ID: 4337
  Gene Symbol: CSAD
  Gene Name: cysteine sulfinic acid decarboxylase
  Uniprot ID: Q9Y600
  ENST ID: ENST00000379846
  CDS Start-End: 105-1145
gcttggggacgcacggagaggtgcagctggggtggctcacacctgtaatcccagcacgttgggaagccgaggtggggaatgactctgctctgccacagatcctgatggctgactcagaagcactcccctcccttgctggggacccagtggctgtggaagccttgctccgggccgtgtttggggttgttgtggatgaggccattcagaaaggaaccagtgtctcccagaagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaata

SEQ ID NO: 123974 - DNA, 2379 bp, Homo sapiens
  Payload ID: 4337
  Gene Symbol: CSAD
  Gene Name: cysteine sulfinic acid decarboxylase
  ENST ID: ENST00000379850
  CDS Start-End: 1-1558
gcttggggacgcacggagaggtgcagctggctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaa

SEQ ID NO: 123975 - DNA, 558 bp, Homo sapiens
  Payload ID: 4337
  Gene Symbol: CSAD
  Gene Name: cysteine sulfinic acid decarboxylase
  ENST ID: ENST00000424845
  CDS Start-End: 70-207
cttggtcctgctgtcctgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtacacatatgaaatcgcccccgtgtttgtgctcatggaagaggaggtgctgaggaaactgcgggccctggtgggctggagctctggggacggaatcttctgccctggtttgtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagg

SEQ ID NO: 123976 - DNA, 565 bp, Homo sapiens
  Payload ID: 4337
  Gene Symbol: CSAD
  Gene Name: cysteine sulfinic acid decarboxylase
  ENST ID: ENST00000424990
  CDS Start-End: 128-565
gagcttggggacgcacggagaggtgcagctggacagatttcatttccctgagccactccatgatttgggccattgaaagagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacgga

SEQ ID NO: 123977 - DNA, 1774 bp, Homo sapiens
  Payload ID: 4337
  Gene Symbol: CSAD
  Gene Name: cysteine sulfinic acid decarboxylase
  Uniprot ID: Q9Y600
  ENST ID: ENST00000453446
  CDS Start-End: 293-1774
acttccgggctcggcagctagactagcgggggcagcctcagagcgggccgtccagcatcaaacactagcctccacacgtggaaaagaccctgactcccacagtagactagtcttatgggagtcctggctcttgggccaggctgcattaggaaaatggaaaccagactgtcttcaaattcttctgcctagccttagccattagagagaggtcctgctaaagatggactgcaaatgcgcttgatggaaggagatgtcaattccactgaagtcctcatttctgctgtagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtga

SEQ ID NO: 123978 - DNA, 581 bp, Homo sapiens
  Payload ID: 4337
  Gene Symbol: CSAD
  Gene Name: cysteine sulfinic acid decarboxylase
  ENST ID: ENST00000437073
  CDS Start-End: 93-581
acttccgggctcggcagctagactagcgggggcagcctcagagcggctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcc

SEQ ID NO: 123979 - DNA, 2122 bp, Homo sapiens
  Payload ID: 4337
  Gene Symbol: CSAD
  Gene Name: cysteine sulfinic acid decarboxylase
  Uniprot ID: Q9Y600
  ENST ID: ENST00000444623
  CDS Start-End: 269-1750
ccacggcttgcgagctactgaagcgctgccgtctgtacggacgacgctgcggtctttggggcttgctcctacctgccaggcgcggcctcccgctggctccctggccgcgcggcgcctcctccaggccccagcacaccctgccaaccccaccgccgcggctgcccccaccgggaccgagggtggctcacacctgtaatcccagcacgttgggaagccgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgtcacagacacacaggcatctcctggatgggatccagagggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaaggtggcccccgtgctcaaggagcgcatggtgaaggagggctccatgatgattggctaccagccccacgggacccggggcaacttcttccgtgtggttgtggccaactctgcactgacctgtgctgatatggacttcctcctcaacgagctggagcggctaggccaggacctgtgagccttctctgtcttgctgccggccttgataccacccctcacccgcagagtcactgcattccctcccagcctttgaggccgggtgcagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaa

SEQ ID NO: 123980 - DNA, 2080 bp, Homo sapiens
  Payload ID: 4337
  Gene Symbol: CSAD
  Gene Name: cysteine sulfinic acid decarboxylase
  ENST ID: ENST00000475890
  CDS Start-End: 50-853
gagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctggtggctccatctccaacatgtatgctgtaaatctggcccgctatcagcgctacccggattgcaagcagaggggcctccgcacactgccgcccctggccctattcacatcgaaggaggtggggaagaggcacaggcccaaccctgggctcctgattctaatctccagccatgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatggctgactctgtggcctggaatccccacaagctcctcgcagcaggcctgcaatgctctgcacttcttctccaggatacctcgaacctgctcaagcgctgccatgggtcccaggccagctaccttttccagcaggacaagttctacgatgtggctctggacacgggagacaaggtggtgcagtgtggccgccgtgtggactgtctgaagctgtggctcatgtggaaggcacagggcgatcaagggctggagcggcgcatcgaccaggcctttgtccttgcccggtacctggtggaggaaatgaagaagcgggaagggtttgagctagtcatggagcctgagtttgtcaatgtgtgtttctggttcgtaccccccagcctgcgagggaagcaggagagtccagattaccacgaaaggctgtcaaagtggctcacgcctgtaatcccagcactttgggaggccgaggcgggtggatcacttgaggtcaggagttcgagaccagcctggccaataaggtgaaaccctgtctctactaaaaatacaaaaattagccgagcatggtggcctgtgcctgtaaacccagctactcaggaggttggggcagaattgcttgaacccagggggcagaggttgcagtgagccgagattgcacccctgcactccaggctgggcaacagtacgagactctgttccaaaaaaaataaaaaagaacagcctttttaggccacagtgacctgcgcaatgtttatatgctttgacctactaactttctcctaactaaatatttgattttaggagagtgtttaaataaattacagtatgtctatatgatgaaatgttattttgccattaaaattttgtttacaaagataatttttattgacataaaaataactttaatgtaatttatgttgaaaaagctgaatacaagtctttatatagagtaatatttgagctgtgttcaaaaatacataggaaaagactgataaaatgaaatatggcaaaatgttaatagttttccctggaataggataataggcaattttaaaacagactcctttaaaaaaacaaacaaacaaaaaaaacatagacttctttatatcttttgagctccctcccttttattatgtaatgaatatgtgttgcttttgtaataggaaa

SEQ ID NO: 123981 - DNA, 455 bp, Homo sapiens
  Payload ID: 4337
  Gene Symbol: CSAD
  Gene Name: cysteine sulfinic acid decarboxylase
  ENST ID: ENST00000548698
  CDS Start-End: 50-455
gagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaagtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctggaggcaattgctgatgtgtgccagcgtcatgggctatggctgcatgtggatgctgcctggggtgggagcgtcctgctgt

SEQ ID NO: 123982 - DNA, 558 bp, Homo sapiens
  Payload ID: 4337
  Gene Symbol: CSAD
  Gene Name: cysteine sulfinic acid decarboxylase
  ENST ID: ENST00000483632
  CDS Start-End: 1-429
attcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagaggaggtgctgaggaaactgcgggccctggtgggctggagctctggggacggaatcttctgccctgtgtcactactccatccagaagggagctgcgtttctgggacttggcaccgacagtgtccgagtggtcaaggctgatgagagagggaaaatggtccccgaggatctggagaggcagattggtatggccgaggctgagggtgctgtgccgttcctggtcagtgccacctctggcaccactgtgctaggggcctttgaccccctgga

SEQ ID NO: 123983 - DNA, 585 bp, Homo sapiens
  Payload ID: 4337
  Gene Symbol: CSAD
  Gene Name: cysteine sulfinic acid decarboxylase
  ENST ID: ENST00000498635
  CDS Start-End: 199-585
tgctactgaggtttttttttgggtgatgaaaatgttctggcgttagatagtgatgatggttgcaacaactttgtgaatttatgaaaaaaacacttaattgtacacttttcaccccacttcctctgccatcttggtcctgctgtcctgaggagctacctgtgcaccctgcctccggctctcctgagcagagagatcctgatggctgactcagaagcactcccctcccttgctggggacccagtggctgtggaagccttgctccgggccgtgtttggggttgttgtggatgaggccattcagaaaggaaccagtgtctcccagaaggtctgtgagtggaaggagcctgaggagctgaagcagctgctggatttggagctgcggagccagggcgagtcacagaagcagatcctggagcggtgtcgggctgtgattcgctacagtgtcaagactggtcaccctcggttcttcaaccagctcttctctgggttggatccccatgctctggccgggcgcattatcactgagagcctcaacaccagccagtacacatatgaaatcgcccccgtgtttgtgctcatggaagag

SEQ ID NO: 123984 - DNA, 1409 bp, Homo sapiens
  Payload ID: 4338
  Gene Symbol: CYHR1
  Gene Name: cysteine/histidine-rich 1
  Uniprot ID: Q6ZMK1
  ENST ID: ENST00000306145
  CDS Start-End: 521-1099
ccaaaccactatgcccacgcacgcacccacccaaacagagcgttttctggtccccgagctcctcccgaccccacccgctcctacggcctccaaccggccccccccaggtctcgaccctctcccccaggcctcgaccctccccccccagccgctctagccccgcccggccgctctagcctccgctcctctcgctggtggaggttcccgaccgcgctcgctcccgcaactgggggcacggcagaggaggcagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaa

SEQ ID NO: 123985 - DNA, 1477 bp, Homo sapiens
  Payload ID: 4338
  Gene Symbol: CYHR1
  Gene Name: cysteine/histidine-rich 1
  Uniprot ID: Q6ZMK1
  ENST ID: ENST00000403000
  CDS Start-End: 589-1167
tcgctggtggaggttcccgaccgcgctcgctcccgcaactgggggcacggcagaggaggcagggccgacggcggtgggcggtgcgttgcgcaggctcgggcctcccgctcgccgctgcgttgggaccgcgcagcccggtaactgcgcacggctggcctcccggagtcctgcgccgtcgctcctcctggacccgggttcccaggacaacgcctcccggaacgcagggagcaggccgaggccgccgcgtgggcctgcagcgcctcgccgctctctcttccccaggcccgcactcccacttgggctccagggccccagggctgacgttccccccagcttagaccctgagtcgttttcccccgtttcccggctgaattaggttcttcttctccacaggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaa

SEQ ID NO: 123986 - DNA, 2020 bp, Homo sapiens
  Payload ID: 4338
  Gene Symbol: CYHR1
  Gene Name: cysteine/histidine-rich 1
  Uniprot ID: Q6ZMK1
  ENST ID: ENST00000438911
  CDS Start-End: 135-1223
aatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactggtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctcagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacactctgtcatggggtcttgagactgaggcttgggcaggaagatccaggtagggtcggggctgccctggccaaccggccgctcccagggagacaggactcagccaccagggctcagcaggcattttccgaaagcagggtgaaattgtctcttcccaggaaaaagattaaactccttgcaggctcttggataagttacacaa

SEQ ID NO: 123987 - DNA, 1162 bp, Homo sapiens
  Payload ID: 4338
  Gene Symbol: CYHR1
  Gene Name: cysteine/histidine-rich 1
  Uniprot ID: Q6ZMK1
  ENST ID: ENST00000424149
  CDS Start-End: 274-852
cccaaacagagcgttttctggtccccgagctcctcccgaccccacccgctcctacggcctccaaccggccccccccaggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggcgatgctgggtgtggcaggcctcctgagccggctggaggaggacaggctgctgctgctaccgaaggaggatgtctgtcgctgggccttggctgtaggcagctgggcttactgccgggccctgcatacacagcgcctccagtgggagtgacagttggatacagccaggcagggtttctgccctgccgaacactttccctcccacctgcctgctcctggcgccttctccctaggggtagactcttctgcctactgaagtgggtttgctgcacattgactggtcaggggcagagtctgggtgctgtcctttggccacgtgtggggacttgtctagaccagaatgaaagggacagggtcccagacacgtttgggggtcctgattctgggctggacacggttgtggatccagagaagaggcctagtctccaataaatcttaggaattttgcaggaatatgaaaa

SEQ ID NO: 123988 - DNA, 853 bp, Homo sapiens
  Payload ID: 4338
  Gene Symbol: CYHR1
  Gene Name: cysteine/histidine-rich 1
  ENST ID: ENST00000533764
  CDS Start-End: 423-853
gaggcagggccgacggcggtgggcggtgcgttgcgcaggctcgggcctcccgctcgccgctgcgttgggaccgcgcagcccggtaactgcgcacggctggcctcccggagtcctgcgccgtcgctcctcctggacccgggttcccaggacaacgcctcccggaacgcagggagcaggccgaggccgccgcgtgggcctgcagcgcctcgccgctctctcttccccaggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctccaggtcttggctgccaccaccacgctggccccagggctgagcacacacgaagactgccttgctggagcctgggtggccaccgtcatcggccttccccttctggccttcgatttccactgggtgaatggggaccgctcctctgccaacctgctcctgggaggaggcatggtgctggcagtggctggcggccacctcggccctgagggccgctctgtggctggtcaggcaatgctgttggtggtcgcagtgaccatcctcattgtagctgtcttcacggccaacacttatgggatgtgggggggggc

SEQ ID NO: 123989 - DNA, 1870 bp, Homo sapiens
  Payload ID: 4338
  Gene Symbol: CYHR1
  Gene Name: cysteine/histidine-rich 1
  ENST ID: ENST00000530374
  CDS Start-End: 208-1422
cgaaaacaaagatggcggccgtgccggggtcggtggccgcggcggctgtggggctacgcgcgggccgggcccactgaggcggcggcgcagggagcggggctgcgggttcgcggcggcggcggcaggagagcggcgggagcgcgcggcgcccctaacttctagtcgggggagcgcgccggcatccgcccgccgggccggccggccgctatgtccggcgccgaggaggccggcgggggcggcccggccgcggggcccgcgggctccgtgccggccggggtcggggtcggggtcggagccgggcccggggcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctcagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgta

SEQ ID NO: 123990 - DNA, 1012 bp, Homo sapiens
  Payload ID: 4338
  Gene Symbol: CYHR1
  Gene Name: cysteine/histidine-rich 1
  ENST ID: ENST00000526887
  CDS Start-End: 274-1012
cagggccgacggcggtgggcggtgcgttgcgcaggctcgggcctcccgctcgccgctgcgttgggaccgcgcagcccggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctgg

SEQ ID NO: 123991 - DNA, 581 bp, Homo sapiens
  Payload ID: 4338
  Gene Symbol: CYHR1
  Gene Name: cysteine/histidine-rich 1
  ENST ID: ENST00000530637
  CDS Start-End: 454-581
atgcccacgcacgcacccacccaaacagagcgttttctggtccccgagctcctcccgaccccacccgctcctacggcctccaaccggccccccccaggtctcgaccctctcccccaggcctcgaccctccccccccagccgctctagccccgcccggccgctctagcctccgctcctctcgctggtggaggttcccgaccgcgctcgctcccgcaactgggggcacggcagaggaggcagggccgacggcggtgggcggtgtgtgcagtggcctcagggatccggaaagtctaggactgaacttctcctaacatccagtaatggggacctggaacctgggcttactagagtgccgcgcgtagggctccaggtcgctggcttctgcgcttccttcctctccaaagttgagtatctcctatctgtgtcctcgtacatactgccgcctgaggtgccatggcccccaagccgggggccgagtggagcacagccctgtcccatctggtgctgggagtggtgtctctgcacgcagccgtgagcacagccgaggcaagtcgaggggctgctgctggcttcctgctcca

SEQ ID NO: 123992 - DNA, 3101 bp, Homo sapiens
  Payload ID: 4339
  Gene Symbol: CYYR1
  Gene Name: cysteine/tyrosine-rich 1
  Uniprot ID: Q96J86
  ENST ID: ENST00000299340
  CDS Start-End: 345-809
agtcgttgccacccgcggagatgaaatgtgagcctgggtggccaaggacgccggagtggccgccttccccgcgcctgagcgcagtggggcgagacaaagagacctgggcccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggacgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacacttcacttccaagtaaaagatgagaaatcaattattcccacaggattttaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacacagattata

SEQ ID NO: 123993 - DNA, 735 bp, Homo sapiens
  Payload ID: 4339
  Gene Symbol: CYYR1
  Gene Name: cysteine/tyrosine-rich 1
  Uniprot ID: Q96J86
  ENST ID: ENST00000400043
  CDS Start-End: 237-635
cccccagcgcagcccgtctcgggccacgggcgccccagctccgcggagtcccgcagtcgctggcccgggacgcgcccggcccgggctcccttggaaggctccctaggcaatggccgggtctctgctccacccggctctcaggagcgctgctctctccatctgatcgccctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctgaatatgaactccatgaggcagagatcttggtctattttgttcaacactctattccaagcatgtaagaccaggcctggtacataatgggcactcagctgaatgaatgatgaacacaactcatgaaaagacctgaattaatcatatatcaataccctagggaattga

SEQ ID NO: 123994 - DNA, 700 bp, Homo sapiens
  Payload ID: 4340
  Gene Symbol: CRCT1
  Gene Name: cysteine-rich C-terminal 1
  Uniprot ID: Q9UGL9
  ENST ID: ENST00000368790
  CDS Start-End: 74-373
gcccattccagttggagaacgtagtgagtctttcagtggagccagggtctggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcggagtttgccccgtaaagcgaattgcactttgatgttcagaaacccactttgttctcagccacgcaaaactccctgaccccgatgtgatttttctccccggggattcgagagccatgcgtgggacactggaccctactgtctacacgggcttgcacacagcaggtgctcagcaaatgtctattgatttgattgtcttttgaagatgtcataataaagcttctacctcctgagaaca

SEQ ID NO: 123995 - DNA, 4158 bp, Homo sapiens
  Payload ID: 4341
  Gene Symbol: CHIC1
  Gene Name: cysteine-rich hydrophobic domain 1
  Uniprot ID: Q5VXU3
  ENST ID: ENST00000373502
  CDS Start-End: 78-752
gttccccctcctcttgcagcacctcggcaggttcaaactcttctccgggagcgtggcggcgatcgcgaggtcacgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcagggggctgattagcaattgagtattttgtaatgtttgggcggggttgctttgttttcagtgaaattggttgcagtgaatgctaaaatgacacagcacactggtgattaattcctcccccatggagccttttttctgttatgcttaggatagaacatacttgtaattttccattaggttagtaacatacttttgtgaaagttgtttttagactgaagaaagtaattttgaatttctttgttacataatattcctttatgaaacttgtgatagtttccagagcaaaacatgtatttgccaaagtatataaatctcacaaggctttaagattacaagctaaaattgttttttaaaattaatgttccaatgtttctcatttggcccaagattctggcttcataaatttgtccaactggctatttttaagcttgtcctaaaagccaataacatgtttattcctaataactaatatgggcaagtgttatttacagatttattaactccatcccagatatgtctccactctttgttccctcctaatgctaatttaggaaagagaccactgtagtaaaactttagaagaagatggagaagtgccttgtctttttagaacaaagataacacattacgtgtaaggaagcataataaatgaattggtagatgattagattagaaatcatccttttcaactaggtctaagaatactttactagtgtattatcttttatttattatgtaaagcttctttccttccttttccccaatcatgatatattagtgacaaaatattacagaaccggactatcagtcacttaaaaaaacagtataattctaatgctagtaaacatgtaatttaatttagttctggaaggacagttgtctttgattaaagccccaccaaaacccatttaagtatttaatgtacatactattcatattattatggcctgtaaacactaatatctgagcaatcaaactgttttatctaccatttttgatgaaatttgaataaagtttaaaaacgtgtaa

SEQ ID NO: 123996 - DNA, 6797 bp, Homo sapiens
  Payload ID: 4341
  Gene Symbol: CHIC1
  Gene Name: cysteine-rich hydrophobic domain 1
  Uniprot ID: Q5VXU3
  ENST ID: ENST00000373504
  CDS Start-End: 86-700
ttcatttcgttccccctcctcttgcagcacctcggcaggttcaaactcttctccgggagcgtggcggcgatcgcgaggtcacgtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaaggtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactacccaaaaaaataccaatttttttcctctcttgtatgactactttttcaaactgttttcctttgcagggggctgattagcaattgagtattttgtaatgtttgggcggggttgctttgttttcagtgaaattggttgcagtgaatgctaaaatgacacagcacactggtgattaattcctcccccatggagccttttttctgttatgcttaggatagaacatacttgtaattttccattaggttagtaacatacttttgtgaaagttgtttttagactgaagaaagtaattttgaatttctttgttacataatattcctttatgaaacttgtgatagtttccagagcaaaacatgtatttgccaaagtatataaatctcacaaggctttaagattacaagctaaaattgttttttaaaattaatgttccaatgtttctcatttggcccaagattctggcttcataaatttgtccaactggctatttttaagcttgtcctaaaagccaataacatgtttattcctaataactaatatgggcaagtgttatttacagatttattaactccatcccagatatgtctccactctttgttccctcctaatgctaatttaggaaagagaccactgtagtaaaactttagaagaagatggagaagtgccttgtctttttagaacaaagataacacattacgtgtaaggaagcataataaatgaattggtagatgattagattagaaatcatccttttcaactaggtctaagaatactttactagtgtattatcttttatttattatgtaaagcttctttccttccttttccccaatcatgatatattagtgacaaaatattacagaaccggactatcagtcacttaaaaaaacagtataattctaatgctagtaaacatgtaatttaatttagttctggaaggacagttgtctttgattaaagccccaccaaaacccatttaagtatttaatgtacatactattcatattattatggcctgtaaacactaatatctgagcaatcaaactgttttatctaccatttttgatgaaatttgaataaagtttaaaaacgtgtaagcctttgaacaaatgtatgaaagctttaaaagatcattagcacttttattttgtttacaaataagctgccatttaaaaaaataaaacctcactacttgaacataaagctcccaaacaatattgtattaaaatgtactatattgacctaggaggatatagaaattatattcacctgattaactggagcagtttcacatagtagaaatactttttgctaatttgattataagtgctcaaatttattgaaattagattctcatgcctataaaagtatactttaaaaatattttgcaacaactgtcaaattatttgggttcctttaaatagcaaacaattgggaaattttccataaaaatgaataggttttattaatacctgttcatgtagtatgtggactaaaacaattgatatatatctgtatgtaaaaatgaatgatcttatcttgccccaaatttttcttacctgattctgagccagcctttttgttttgatggcaccctgtgagtatgttccattttctgtgaactttgtcaaattcatactatatgaggaaatgatctaatattgtgggctccaggcaggtcatcttaattgcatgtctgtctcttctgtaaaatgatgaggtggaacctagagctggacaaaaaattagagatcacttaacattctgtgattcaaggaattcttaggacatttttactctatagaatctcagaatgattattctcagatctactgtccttggtggaaactctcacagtgccttgcatgcagtaaaagtttgatttgccgactggctgacgtgttaattatcacacagactccaagaacctgatgcttgctagaccttagttccttggtgatgctaagagtaaatgtagttttcctaggaactgagcactgaggtctgtgtcctttgcctgtgtagaatctgtctatgcagttggtattcaggcaagaattttagctgtaacaacaatggaaatattggaggacccactttggcatttatgtaaagatttcatatcctatccaacatttactttagtgtctaatcaaattccataccctcaaaaagatctgttggaacaaattgataaaattaggtggaaaggaaagtggtatgggactcaaatacaagtcacttctggtttaattattggctctgctgcttaattcctctgtacctcacgtcctcattgtcgaagtggggacaataatctggacctacctcacaggggaattgaggatattttcatatattagtgtgctttgaagttgactgaaagatatactggatatcataattatataatttctaaatagatttctttaaatccatgctatgttttctttttcagtcaggtcctacagaatgactattgcacttggtctattgttttaatagtaaattttgttattaatctcctatgtgttaaacgtgggtaattgtattatgttaatacatacttagggaggaaaagcaggtggatgtaaatcagtgattcccaacttcagcagatgatagcagtggagggtatccttgagctttttgtaatatttcaaaaagtatattagaaattatacatttacccataatattcctgcttcacaagtcaattaagacattgaatttccattcattttgcctatattctctcaaaagctgtgaatggcagtatgtttttgattaataataaaataagaaatcctattatgtgcaacttattaaatacttgggaacatgggaaaagaataatgaagggattcttatggtgaaaatgttgggaaccacttttataaaggaactaagattatttgaccccctccacagattgcttacctagtctctaaataatgaaatgtgtgtgtttgtgtgttttggctatattaggctatataacttcaggttagaatttgccttcagttttttttctgttttagaatatcactggcctaatttatttaggtgtgtacatgttgctcatacatacacacacatataggattacaaatgtggaaaatgttataatgtcatattctagcattggactaaatatcaatttctgactcttaaagtagttctgtgtataaattcaacatgatgaatcaaggcaataatttctcaaatgttcttttatttctttgtttttatctcgactttttattttccattttttctagtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatctggtggagaagcctaggatttcaactttttgtcagaggattcctgttgggacagctttaccagaaaagaataatagcggatatgttcatccaaactaagaactttcatgcatcttgcattgttacatagcctgtggaatgaattcattttttctcccttgagtccaggaatgacttccctggaaaaactcaatctatatacagctgtgccaaaatgaaggatacctgcctctccgaaactttcactgctgcttctgtcattgttcacttgtcagataaaattttattatctcaggatgcaaatttaaaataaagtgtaaatctatgttaa

SEQ ID NO: 123997 - DNA, 967 bp, Homo sapiens
  Payload ID: 4341
  Gene Symbol: CHIC1
  Gene Name: cysteine-rich hydrophobic domain 1
  ENST ID: ENST00000498407
  CDS Start-End: 25-678
gtgatgagcatcctgctgcccaacatggcggagttcgacaccatctcggaactggaggaggaggaggaagaagaagcggcaacgtcgtcgtcgtcgccgtcgtcgtcgtcgtcggtatctgggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaaggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatgtacgcaaatagtgtaaaattgttttaatgcctggactttgaaacaagtaacaagtgtttgaaagtatataatctacgagcgaatttgccctccttggactaaccacatacaaatatgaatctggctgcaagaacaggatatccaggtaactagagagtgggcattgataaaaatatct

SEQ ID NO: 123998 - DNA, 2800 bp, Homo sapiens
  Payload ID: 4341
  Gene Symbol: CHIC1
  Gene Name: cysteine-rich hydrophobic domain 1
  ENST ID: ENST00000498318
  CDS Start-End: 1-193
ggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatactgaatttccctccgttctaacagggaagaaattctagagagatacacatgaaactaataaaagttattacctttgatgggagaagaggaatgtgatggatagaggcaagggtggccccagaagaatttaaaaccagcattggccgtgtgaatgcatgtttgaaaaaggctctcccggtcaatgtgaaatggctgctgtgtggttgtctctgctgctgttgcacactgggttgcagcctatggcctgttatttgtctcaacaaaagaaccagaagatcaattcagaagttaatagaatgggaaaataacagattatatcacaagcttgctttgcactggaagttgactaagaggaaatgtgaaactagcaatatgatggagtatgtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccctttgtaacaagtggactaaaattgaaattattatctcagatattctgtattgcacctgaaaccatgacctttatttttccatttcgtttaataatttccattttgttgtctactccttcccacaaaaaaactatttgacatctgacacatttcacagtctcactatcctgcatttattagccttttcttcctttgaaaatacacacaattatgacttttaaggagtattttgagatttcagacatcttcagaaggtatctagaccctcttgaaagccactaacacctttctgcagttctgatattctagtttgagaaagagagagaactatttgagaagctgtagctaaagagtatatagcagctgattcataattgaaaaaaaattctcaattctgtttttgatgatcctttataaaacattaatgaggaaagacaagtgtttagacaaaagtattttagtttataaattcagcacatatgtaacatttatttggtccatatttctctatttttcttcacaattaaaatgattgctagcaccacacaactagaatttgaaaattcagtataatgaaagctttatatcacattaattcaactgcaaatgtatgcctgtttgtaggcattatttgtaattcatagtgctaaaaataaaagtgtctagggctcagtaatattttgtcatcttactcttactgcttttagtaaaccttttaggcaagattcatctcagtgaagtgaacaatcatttcttcatagaaggtcaagcctttttaagccactcttaaaatttatgcctaatttgaaatccacagtccttgaccagtttaaaaaagagaggaaaaagaagacactattttatatgtgattataattgtttgcacaaacacttttccaccttcctctgtgccccattacctctgtgccactcagtcaccccaaatctctaacctttagtaatgtgtatgcctgcaaatattatgtgtttgcctgctgcaaaattgaaggtgtatttttatagacaaggtagaagcctctgaaaatgtataccaaatgtcttgttttgtagctaaggtcgggaaaaattgtatctgaggtttatgttccagctaatgttatcaaatttatgcttcaaactgtgatattttaataccaaaatcgattttcagcataatacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaacca

SEQ ID NO: 123999 - DNA, 1194 bp, Homo sapiens
  Payload ID: 4342
  Gene Symbol: CHIC2
  Gene Name: cysteine-rich hydrophobic domain 2
  Uniprot ID: Q9UKJ5
  ENST ID: ENST00000263921
  CDS Start-End: 391-888
acgcgcccgcccgcccgttggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgtttttgttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaa

SEQ ID NO: 124000 - DNA, 528 bp, Homo sapiens
  Payload ID: 4342
  Gene Symbol: CHIC2
  Gene Name: cysteine-rich hydrophobic domain 2
  ENST ID: ENST00000510894
  CDS Start-End: 1-412
ggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttt

SEQ ID NO: 124001 - DNA, 711 bp, Homo sapiens
  Payload ID: 4342
  Gene Symbol: CHIC2
  Gene Name: cysteine-rich hydrophobic domain 2
  ENST ID: ENST00000512964
  CDS Start-End: 1-441
atggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagactgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgtttttgttttttttttaaataaccgcatgttctaagtgtgcatttttgtcaatctttgcaacagttatttcatacagatgtttaatacttaagttattgtgctcttttctgttatgtattctgattttcaaggattacttttttgt

SEQ ID NO: 124002 - DNA, 4438 bp, Homo sapiens
  Payload ID: 4343
  Gene Symbol: CRIPAK
  Gene Name: cysteine-rich PAK1 inhibitor
  Uniprot ID: Q8N1N5
  ENST ID: ENST00000324803
  CDS Start-End: 2961-4301
tagtgaaaaaaaaatgtctttaagtcccttttgtatgttattagtatagccacttagctcttttttgattattgtttgcatggtatcttttttcaccctttaactttcattgtatctctgaatctaaagtgtgtttcttgtaaacagcatatagtgggatcatgtttcttatctgtcctgctggtctctgccgtgaatctaaagtgtgtttcttgtaaacagcatatagtaggatagtgtttctcatctgtctttctggtctctgctctgaatcaaaagtgtgtttcttgtagacagcacatagtgggatcatgtttttcatctgtcctgctggtctctgctgtttgagagggatgtttaatccatttacattcagtgtgattactgagaaagttggatttgtatctgccatttctaaatttgtttactatattgtcttttttgtctttcttcctttatttctccattacttttttgtgttaaatggacatttaattctcttgtaacattgtaatttccttgtctgttttactgggtttttttaaaagtaactttcttagcagctgctctgagtattacagtaacaacgtaaaaccaatcaagtgttcagatgaacttaatataatgtacaaaaaccttcacttcaagtagctttgtttcctctcagcttcttggtgctgtatttgtcatataaatgctaccttttagattgtaagtccgtcagcagtcttgtaattattgctttatgcagttgtcttttaaatcacatagaagaagaaaagatgtacaaacagaaatgagtttctgctgtctctgttgctggctttgcagttgtcttttttggtgctctttgtgtggatttgagtgtggtgtcttggacttcagcctcaagtatttcttgtaggacagatcttctagcaatgaattctctttgtttttgtttatctgagaatgttgtaatttttccttctcttctgaagaataattgtgctggatatggctgacttggttggccctctttttctttcagtcctctatagatgtcattccactgcctctggcatctgtggtttccatggcgggagcaccgcaccatgtctcagtctctttttagcttctgactgtttgactgtggtgtgtctaattgtggatctttcagtgtgtcctacctgcagttctttgagcttcttggatatagaggttaatatttcttgtagtctgattgtttacatcttctcttcacttattgatcttctgcctagttatattgatattgaatgtgggtattgaatccttcggttttgtcagcttcatgttcagccagtgactggacaggggacccctttaagtgctttgcaccagtaactctcatggttctgctgacacacagttgatgtgtggtgagtatgccttcagcgctccattgtggttctgcaaatttgggaaattttaggttgtcgtttctcgaaatattttatgtccatgttctcttcccccacttggactccagctacgtgtgttgatgtggagctgggcacagccttggaggcctccttgactttcctttattccggaattttttcttcttctcagaatgggtcatctcagttgacctatcttcaaggtcacagatgcttttgccaaacaaaacctgatgtcaagctgctctagtgaatttttcatttcagttattgtacttttctactccaaacttccatttggctctctcctataatttctgtatctttactcatattctttgtttagtgaaacattctcatactttaattctgtagacacagtttcctttagttatttgaacatatgtgtagaagctgatttaaagtacttgtctaagccgggcgtggtggtgtgcacctgtaatcccagctacttgggaggcagaggcaggagaattgcttgaacccgggaggcagaggttgcagtgagccaggatcaagccattgtactccagcctgggccacagagcgagacgctttcaaaactagatagatagatagattagatagatagatagatagatagatagatagatagatagataggataagataagatagataggtgacttgtctactaagttcaacatcagggcttattcaggggaagttcctattgatgaccttttttcccatgtcagagccaaggaaataacatactctttctttgtggtctcatatatatgtattttttgaagactggacactttaataatgtgctgtgcaactctggaaatcagataccctctccacgagtttattgttgttctgttgctgttaccttttgtttagtgtgtgttctggactaatttgaagtgtccacctcatcagcttcatgttcagccagtgactggacagaggacccctttaagtgctttgcaccagtaactctcacggttctgccgacacgcagttgatgcatggtgagtgtgccttcagcgctccatcgcggttctgctgacacgcagttgatatgtggtcagtgctccagcaggcagctgccaactgtgcctttgccttcacttcttacttgcacacagccacaaagccagccagaggtgagggccagggcagctcaggttcctctcgggcacacacacagctctgtgcctgtgtgggcacagccttccatgcctccaggagtgtggcagagcttctcagcggccactgtgggcatctcgttcctcagatcttcctttcatgagttatgtagttgaattatcaatctttcttggcttctaagttttgtgttctacttagaatgctcttcccccttaaagattatatttgaaatgttttccatgttttcttctagtacttttatgggtttcattttcatattgaaatcattgatctacttctagtttttgatacaaaatgtgagccaggaaacccagtttttaaatttcaaatagctgtccaggtgtccctgcacctcttatgcatgagccctcgctttgtgccaatgtggagtgcccgcctgctcacacgtgcccatgtggagtgcccgcctgctcatgtgcccatgtggagtgcccgcctgctcacacatgtcgatgcggagtgcccgcctgctcacacatgcccatgtggagtgcccgcctgctcacacgtgcccatgtggagtgcccgcctgctcacacacgtgtccatgtggagtgcccacctgctcatgtgcccatgtggagtgcccacctgctcacatgtgccgatgtggagtgccacctgctcacacacgtgcccatgtggagtgcccgcctgctcacgtgcccatgtggagtgcccgcctgctcacacgtgccgatgcggagtgcccgcctgctcacacgtgcccatgcggagtgcccgcctgctcacacgtgcccatgcggagtgcccgcctgctcacacgtgcccatgcggagtgcccgcctgctcacacgtgccgacgtggagtgcccgcctgctcacacgtgcccatgtggagtgcccgcctgctcacacgtgccaacgtggagtgcccgcctgatcacacgtgcccatgtggagtgctcgcctgctcacacgtgccgatgtggagtgcctgcctgctcacacgtgcccatgtggagtgttcgcctgctcacacgtgccgatgcggagtgcccgcctgctcacacgtgccgatgcggagtgcccgcctgctcacacgtgcccatgtggagtgcccgcctgctcacgtgccgatgtggagtgcccgcctgctcacacgtgcccatgtggagtgcccgcctgctcacgtgccgatgtggggtgcccgcctgctcacatgtgccgatgtggagtgcccgcctgctcacacgtgcccatgtggagtgcccgcctgctcacacgtgccgacgtggagtgcccgcctgctcacgtgcccatatggagtgcccgcctgctcacacgtgccattgtggagtgcccgcctgctcacacacatgccgatgtggagtgcccgcctgctcacacgtgcccatgtggagtgcccgcctgctcacacgtgcccatgtggagtgcccgcctgctcacacacgtgcccatgtggagtgcccgcctgctcacacgtgcccatgtggagtgcctgcctgctcacacacgtgcccatgtggagtgcccgcctgctcacacaaagccctggcatggtggttctgtaggtttcctgtcctgccggccgagtcagacgctgttaccgtacattctactcatggtggctttttaatacgtttttatgtcaaggatcccttttatatttctctgcacctcgagataacgtaggaatattagggatgagatggaagaggagagggtgtttttgtaaaattgaattcaggactgatttgttagcctggtgcttttcgtatcagaccttttaatgaattttcatggatgctgattaaaagacaaacctgtga

SEQ ID NO: 124003 - DNA, 1953 bp, Homo sapiens
  Payload ID: 4344
  Gene Symbol: CRIPT
  Gene Name: cysteine-rich PDZ-binding protein
  Uniprot ID: Q9P021
  ENST ID: ENST00000238892
  CDS Start-End: 133-438
gggagtatgggcttagaagccggaagtgggttgacgtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagataattaagtttaaaccagagaatttgattgttactcattttgctctcatgttctaaacagcaacagtgtaactagtcttttgttgtaaatggttattttccttataagaattttaagaactaagtggcaaattccatgaaaatatttctcagttctgtatgcacttttatttaacattattcatataattctccccccaccactttatttatagatactgcaaaagtgagaaggagataatagatactttgctctgaatttggcatccagagttaacatttctcccctcactcccttgctggtgtcatagttattagaatcagcagcctcttaactaattgcggtttcataggatatataaatgtttcaagccattattgctgaatggttctttagttattaacctagacccaaatcaaagaccagttggatttatgatattttttatttgttcttgcagccaaagtgccagtttctttaatatgtgaccaagaacacaaggagcatccatatggccaaataaatacactgaattttagaaaaacatattactttgaattcaaattgtcatgaaaaccagaacagtgtttgtccatgttgcatgtaatgaaaataaatccctgctctgagaaaagctctttgaagcaaaaaccaaacttttttttttttttttttacctcctgtcttgccccctaaaagaaataaatagagcaaacatcttgactctccctttttaaaatttgtttgttttttttttttttttttggatacaagagctcactctgttgcccagggtggagtgcagaggtatcatcaggctctctgcagcctccatctgctgggctcaagcaattcttccccctcagcctcctaagtagctggggactacaggcgtgtgccactgtgctcagctagtttttatttttagtagagatgaggactcactatgttgcccaagctgttctcgaacttctgatctcaagcaatcctctggcctcagccttccgaagtgctgggatacaggtgtgagccacagaacttggcctctctcttttttttttttttttttttttttttttaacactacaggtttcaaatgaatacttttcttatgttgccttcagaggttcaggacttctgcttttaaaacctgcagcctaccgtgggaaaccaaaaaagcattccctatttccaactgcagtatgtataaatacatatcactacaaaatgtatagaaagtgtgatgagatacatgaatggcatttttattggtcataacattttgatgaaaagcatttaaagttttaactttataaggcttttcaaaatgtgtttttctgagatacattgttatttattcatatccagaaaaattacaaggataatacagaatataataaataatttatctgagagca

SEQ ID NO: 124004 - DNA, 460 bp, Homo sapiens
  Payload ID: 4345
  Gene Symbol: AL928654.7
  Gene Name: Cysteine-rich protein 1
  ENST ID: ENST00000547184
  CDS Start-End: 1-139
gaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacctgtccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctc

SEQ ID NO: 124005 - DNA, 980 bp, Homo sapiens
  Payload ID: 4345
  Gene Symbol: AL928654.7
  Gene Name: Cysteine-rich protein 1
  ENST ID: ENST00000551180
  CDS Start-End: 1-139
gaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcagggccaggcccagcttctgcaagggcctgatgaggctgctctgcccctgacccaggcaccactgccccatgtgcgtcctcatctgccatctaccctgtgcccagggacttacccagtggcccggcgtccagtggggaacttgagtaccggccgtgcacaggggctggggggccttctggaaactcccttgtcaactcagccagccgctgctgactggccaccttcagagaccctcttccccacactggctacttagataccggccttggcagaaggccacccctccggacacccactggtttaaaagagcccaggggtctggccctgccttagggctgtggtgggtgtgctgcaggctcagctcgacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctc

SEQ ID NO: 124006 - DNA, 678 bp, Homo sapiens
  Payload ID: 4345
  Gene Symbol: AL928654.7
  Gene Name: Cysteine-rich protein 1
  ENST ID: ENST00000477724
  CDS Start-End: 62-295
tctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccagccctgccaggagcccggaagtgggtccgcacgagacagaatagactacactcaaactccaggggaaccgttcattgggcttggacacgaaggcgggaccctgccgacgcagtgattggatgcatgtccggccagcgcgacctccgcgctctggcagctcctcttccgtgtgctctcgccactccctgcgggcaacgccttggcatcgctcgccctggaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcc

SEQ ID NO: 124007 - DNA, 613 bp, Homo sapiens
  Payload ID: 4345
  Gene Symbol: AL928654.7
  Gene Name: Cysteine-rich protein 1
  ENST ID: ENST00000550554
  CDS Start-End: 1-139
gaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcaggccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctc

SEQ ID NO: 124008 - DNA, 337 bp, Homo sapiens
  Payload ID: 4345
  Gene Symbol: AL928654.7
  Gene Name: Cysteine-rich protein 1
  ENST ID: ENST00000553228
  CDS Start-End: 1-148
gaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattggacctccgcgctctggcagctcctcttccgtgtgctctc

SEQ ID NO: 124009 - DNA, 1311 bp, Homo sapiens
  Payload ID: 4346
  Gene Symbol: CRIP1
  Gene Name: cysteine-rich protein 1 (intestinal)
  Uniprot ID: P50238
  ENST ID: ENST00000330233
  CDS Start-End: 944-1177
aactttgcagcgtacttggaccgctctggccgccctgggcgctacccgcagagataagggcccctccctgcgcccggtccgggcatctccgagccggcctgggggtggctgaactctcttttgccggccgaaaccccagcccccgcagcccccgcagccgatcggtcctcaagctacagctcccctctctgggagtccccgcttttgaattccccggggatgttcccgctgcggtccgatggacctcccagagcagcggaggtcaggggagctagcagaggcggggacgtcccttgggagtgaggggactgacaggggcggcctcgtaaccctgcgtgggatggaaggtcagagtgggttcctcggtggggggcaacagcgggggctctccggcaattgtccccgaccctccgtcctggggagggcaggatcagcgcgcgggctgctttgcatctctttgcattttagtgatgtttggtccagtcctggcccgggcagatctggggttcgggcgggtgccggtggggtagggctgggggtgggagcggcgtttcctgctgcgggtgagccttttgcctcggaactggacccgggagacatcacagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacc

SEQ ID NO: 124010 - DNA, 485 bp, Homo sapiens
  Payload ID: 4346
  Gene Symbol: CRIP1
  Gene Name: cysteine-rich protein 1 (intestinal)
  Uniprot ID: P50238
  ENST ID: ENST00000392531
  CDS Start-End: 118-351
cacagcgctgggctaggggcgcggcttgaactcgcctaaagagctgcgccctctcatctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacc

SEQ ID NO: 124011 - DNA, 677 bp, Homo sapiens
  Payload ID: 4346
  Gene Symbol: CRIP1
  Gene Name: cysteine-rich protein 1 (intestinal)
  Uniprot ID: P50238
  ENST ID: ENST00000409393
  CDS Start-End: 154-387
tttcctgctgcgggtgagccttttgcctcggaactggacccgggagacatcacagcgctgggctaggggcgcggcttgaactcgcctaaagagctgcgccctctcacccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcagg

SEQ ID NO: 124012 - DNA, 1857 bp, Homo sapiens
  Payload ID: 4347
  Gene Symbol: CRIP2
  Gene Name: cysteine-rich protein 2
  Uniprot ID: P52943
  ENST ID: ENST00000329146
  CDS Start-End: 714-1340
gcgccttccttcctgagccctgccctccacccaaggagccttcagcaccacagacagtgttggggcggggcgcgggcgggggcggagcgggacatggagacccggacagggctgggggccgtgcccgccgggaatctgactccgctcccgcggcgcggctgttgctatggaaaccgagcaacaaagggaagcgggacaggcgccgcgcgcggcggggtgggggtggggttctcccggagcctgcgaccccttcccgcggcggagcgcagcctgggcgcccagggccgggagtgttggacccctaggcccaagtcactagggctccccgagagccgagggccaggctccccgcaccctgcccgccgccccggggacggcccggccaggcggccccgacgtcgccatggaaacagccggggcgcgggcggcgccgcggtcgcccgggcgggcccctgtagacgccacctccggcgcgaggggcccgggggcgccaggcctggcccggctgccccgcacccgccacccccggcaggtgcgccccgcccccgcggcgcccccaggcggcccccagcccgggggacgggttatcgaggccccgccccggccgcggagccaatgggcgcgcggacagccgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtc

SEQ ID NO: 124013 - DNA, 1176 bp, Homo sapiens
  Payload ID: 4347
  Gene Symbol: CRIP2
  Gene Name: cysteine-rich protein 2
  Uniprot ID: P52943
  ENST ID: ENST00000483017
  CDS Start-End: 287-1135
ggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccag

SEQ ID NO: 124014 - DNA, 991 bp, Homo sapiens
  Payload ID: 4347
  Gene Symbol: CRIP2
  Gene Name: cysteine-rich protein 2
  ENST ID: ENST00000538259
  CDS Start-End: 1-577
ggaggagaacgggcggagggcgcgggccgaccgggcgcaccgaccatggcctccaaatgccccaagtgcgacaagaccgtgtacttcgcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctg

SEQ ID NO: 124015 - DNA, 817 bp, Homo sapiens
  Payload ID: 4347
  Gene Symbol: CRIP2
  Gene Name: cysteine-rich protein 2
  ENST ID: ENST00000550577
  CDS Start-End: 1-313
gcccggaggagaacgggcggagggcgcgggccgaccgggcgcaccgaccatggcctccaaatgccccaagtgcgacaagaccgtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgagga

SEQ ID NO: 124016 - DNA, 800 bp, Homo sapiens
  Payload ID: 4348
  Gene Symbol: CRIP3
  Gene Name: cysteine-rich protein 3
  Uniprot ID: Q6Q6R5
  ENST ID: ENST00000274990
  CDS Start-End: 6-659
gagctatgagctggacctgtccgcgttgccagcaacctgttttcttcgctgagaaggtgagctccctgggcaagaactggcaccgcttctgcctgaaatgtgagcgctgccacagcatcctgtcccctggcgggcatgcagagcacaatgggaggccatactgccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaagccctccccatatgaagacattcactggggagacctcgctgtgccctggctgtggggagcccgtctattttgctgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgggcagccccatcccagacactgggatggcatgtacatgcctgaagtatggcatgtacatggtctgtgggtatgtgtggacaacttcccctgtggttaagcataccctggcccccccaccaagttccctctaggcctgaaccctgcaccacagacccagggcctttggtgatagggctctctctctcaggtgtgaacattggcgatgtgggctgctacatctatgacccagtgaagataa

SEQ ID NO: 124017 - DNA, 962 bp, Homo sapiens
  Payload ID: 4348
  Gene Symbol: CRIP3
  Gene Name: cysteine-rich protein 3
  Uniprot ID: Q6Q6R5
  ENST ID: ENST00000372569
  CDS Start-End: 6-620
gagctatgagctggacctgtccgcgttgccagcaacctgttttcttcgctgagaaggtgagctccctgggcaagaactggcaccgcttctgcctgaaatgtgagcgctgccacagcatcctgtcccctggcgggcatgcagagcacaatgggaggccatactgccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaagccctccccatatgaagacattcactggggagacctcgctgtgccctggctgtggggagcccgtctattttgctgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaatttcagcctctgtggcttcttcaataaaatgttggctccca

SEQ ID NO: 124018 - DNA, 474 bp, Homo sapiens
  Payload ID: 4348
  Gene Symbol: CRIP3
  Gene Name: cysteine-rich protein 3
  ENST ID: ENST00000451294
  CDS Start-End: 1-117
gagcccgtctattttgctgagaaggtgatgtcattaggcagaaattggcaccgaccgtgtctgaggtgccagcgttgccacaagaccctgactgctgggagtcatgctgaggtgtgaacattggcgatgtgggctgctacatctatgacccagtgaagataaaattcaaatgagacgctcacaaaaaaggtcaccctaactcaggcctcccatcatgcccctcatggtccaatggaagctacaaaaatctccagtcccatgggggttggggaaggtgggatcttgggggcctgggcctaggctccatggtaggccagagagtctagactttctctgccaattttttccctttcccatttctatctggttagggaacagcccgttttgaagggtatcctcctcctggccatcacaacccctttccccagcacattctggagcttcaaggtactcataaaacttgtgtttattgaa

SEQ ID NO: 124019 - DNA, 430 bp, Homo sapiens
  Payload ID: 4348
  Gene Symbol: CRIP3
  Gene Name: cysteine-rich protein 3
  ENST ID: ENST00000416431
  CDS Start-End: 1-331
ccacaagccatgctatggggctctctttggacccaggggggtgaacattggtggtgtaggctcctacttgtacaatccccccactcccagccctggctgcaccactcctctcagccccagcagcttcagccctcccaggccaaggactggcctcccccaaggcaagaaaactgagaaggtgatgtcattaggcagaaattggcaccgaccgtgtctgaggtgccagcgttgccacaagaccctgactgctgggagtcatgctgagcatgatggagtcccctactgccacgtcccctgctacggctacctgtttggccccaaagccctctaggtcctgcctgtttcttgcctgcctcacccagtggcatcacgatgatggtaaaaccagccagggctgagccagtaagggtgcgggtgatggcaaacatta

SEQ ID NO: 124020 - DNA, 1709 bp, Homo sapiens
  Payload ID: 4349
  Gene Symbol: CRISP1
  Gene Name: cysteine-rich secretory protein 1
  Uniprot ID: P54107
  ENST ID: ENST00000329411
  CDS Start-End: 4-540
gggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttg

SEQ ID NO: 124021 - DNA, 1911 bp, Homo sapiens
  Payload ID: 4349
  Gene Symbol: CRISP1
  Gene Name: cysteine-rich secretory protein 1
  Uniprot ID: P54107
  ENST ID: ENST00000335847
  CDS Start-End: 103-852
aaatctcccctgtggactgtcatttaaaagcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttgaaaaaaaaaaaaaa

SEQ ID NO: 124022 - DNA, 1793 bp, Homo sapiens
  Payload ID: 4349
  Gene Symbol: CRISP1
  Gene Name: cysteine-rich secretory protein 1
  Uniprot ID: P54107
  ENST ID: ENST00000507853
  CDS Start-End: 74-610
gcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttgaaaaaaaaaaaaaa

SEQ ID NO: 124023 - DNA, 1296 bp, Homo sapiens
  Payload ID: 4349
  Gene Symbol: CRISP1
  Gene Name: cysteine-rich secretory protein 1
  Uniprot ID: P54107
  ENST ID: ENST00000505118
  CDS Start-End: 91-840
agtttctttgcagctaccaggacagagcttggtgagataattcttttattcttcaacttttattttaacttcaatggtacatgtgcagggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaa

SEQ ID NO: 124024 - DNA, 1382 bp, Homo sapiens
  Payload ID: 4350
  Gene Symbol: CRISP2
  Gene Name: cysteine-rich secretory protein 2
  Uniprot ID: P16562
  ENST ID: ENST00000339139
  CDS Start-End: 238-969
cggtgagaggggcgcgccgcagctcctcaacgccgcaacgcgccggcccaactgcaggaaggtctgtgctctggagccagggtaaatggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctg

SEQ ID NO: 124025 - DNA, 1492 bp, Homo sapiens
  Payload ID: 4350
  Gene Symbol: CRISP2
  Gene Name: cysteine-rich secretory protein 2
  Uniprot ID: P16562
  ENST ID: ENST00000618917
  CDS Start-End: 241-1077
acacgtggcgcctggcaagtgaacaatcgcggtgagaggggcgcgccgcagctcctcaacgccgcaacgcgccggcccaactgcaggaagggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgcaatgaaaacatatctcaataaaagggaggggataaacgtttggaaatgttttttaaggttgagacactttcaacttctcagaggagaacaacttctcactttcagtggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgcc

SEQ ID NO: 124026 - DNA, 1376 bp, Homo sapiens
  Payload ID: 4350
  Gene Symbol: CRISP2
  Gene Name: cysteine-rich secretory protein 2
  Uniprot ID: P16562
  ENST ID: ENST00000616725
  CDS Start-End: 230-961
acacgtggcgcctggcaagtgaacaatcgcggtgagaggggcgcgccgcagctcctcaacgccgcaacgcgccggcccaactgcaggaaggtctgtgctctggagccagggtaaatggttataaaattatacaccatggccctcctaaagacactctaggaaaaccatgtcatcctgatcttaaaacacctgcaagaaagagcacagtacttcaccattatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctgcc

SEQ ID NO: 124027 - DNA, 2170 bp, Homo sapiens
  Payload ID: 4351
  Gene Symbol: CRISP3
  Gene Name: cysteine-rich secretory protein 3
  Uniprot ID: P54108
  ENST ID: ENST00000263045
  CDS Start-End: 48-824
atatacggctctaaccttctctctctgcaccttccttctgtcaatagatgaaacaaatacttcatcctgctctggaaaccactgcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgataaatatagcagggtaatgtaagatgataacgttagagaaactgaaactgggtgagggctatctaggaattctctgtactatcttaccaaattttcggtaagtctaagaaagcaatgcaaaataaaaagtgtcttg

SEQ ID NO: 124028 - DNA, 645 bp, Homo sapiens
  Payload ID: 4351
  Gene Symbol: CRISP3
  Gene Name: cysteine-rich secretory protein 3
  ENST ID: ENST00000354620
  CDS Start-End: 71-645
aaaacaggaaataggtgtttcatatatacggctctaaccttctctctctgcaccttccttctgtcaatagatgaaacaaatacttcatcctgctctggaaaccactgatccctgttccaccggttttgttttcccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttg

SEQ ID NO: 124029 - DNA, 872 bp, Homo sapiens
  Payload ID: 4351
  Gene Symbol: CRISP3
  Gene Name: cysteine-rich secretory protein 3
  ENST ID: ENST00000371159
  CDS Start-End: 20-850
accttccttctgtcaatagatgaaacaaatacttcatcctgctctggaaaccactgcatgtaccaatcattttaatgcagatccctgttccaccggttttgttttcccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtag

SEQ ID NO: 124030 - DNA, 2205 bp, Homo sapiens
  Payload ID: 4351
  Gene Symbol: CRISP3
  Gene Name: cysteine-rich secretory protein 3
  Uniprot ID: P54108
  ENST ID: ENST00000433368
  CDS Start-End: 71-877
aaaacaggaaataggtgtttcatatatacggctctaaccttctctctctgcaccttccttctgtcaatagatgaaacaaatacttcatcctgctctggaaaccactgatccctgttccaccggttttgttttcccagcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccagaaacatgctgaagatggaatggaacaaagaggctgcagcaaatgcccaaaagtgggcaaaccagtgcaattacagacacagtaacccaaaggatcgaatgacaagtctaaaatgtggtgagaatctctacatgtcaagtgcctccagctcatggtcacaagcaatccaaagctggtttgatgagtacaatgattttgactttggtgtagggccaaagactcccaacgcagtggttggacattatacacaggttgtttggtactcttcatacctcgttggatgtggaaatgcctactgtcccaatcaaaaagttctaaaatactactatgtttgccaatattgtcctgctggtaattgggctaatagactatatgtcccttatgaacaaggagcaccttgtgccagttgcccagataactgtgacgatggactatgcaccaatggttgcaagtacgaagatctctatagtaactgtaaaagtttgaagctcacattaacctgtaaacatcagttggtcagggacagttgcaaggcctcctgcaattgttcaaacagcatttattaaatacgcattacacaccgagtagggctatgtagagaggagtcagattatctacttagatttggcatctacttagatttaacatatactagctgagaaattgtaggcatgtttgatacacatttgatttcaaatgtttttcttctggatctgctttttattttacaaaaatatttttcatacaaatggttaaaaagaaacaaaatctataacaacaactttggatttttatatataaactttgtgatttaaatttactgaatttaattagggtgaaaattttgaaagttgtattctcatatgactaagttcactaaaaccctggattgaaagtgaaaattatgttcctagaacaaaatgtacaaaaagaacaatataattttcacatgaacccttggctgtagttgcctttcctagctccactctaaggctaagcatcttcaaagacgttttcccatatgctgtcttaattcttttcactcattcacccttcttcccaatcatctggctggcatcctcacaattgagttgaagctgttcctcctaaaacaatcctgacttttattttgccaaaatcaatacaatcctttgaattttttatctgcataaattttacagtagaatatgatcaaaccttcatttttaaacctctcttctctttgacaaaacttccttaaaaaagaatacaagataatataggtaaataccctccactcaaggaggtagaactcagtcctctcccttgtgagtcttcactaaaatcagtgactcacttccaaagagtggagtatggaaagggaaacatagtaactttacaggggagaaaaatgacaaatgacgtcttcaccaagtgatcaaaattaacgtcaccagtgataagtcattcagatttgttctagataatctttctaaaaattcataatcccaatctaattatgagctaaaacatccagcaaactcaagttgaaggacattctacaaaatatccctggggtattttagagtattcctcaaaactgtaaaaatcatggaaaataagggaatcctgagaaacaatcacagaccacatgagactaaggagacatgtgagccaaatgcaatgtgcttcttggatcagatcctggaacagaaaaagatcagtaatgaaaaaactgatgaagtctgaatagaatctggagtatttttaacagtagtgttgatttcttaatcttgataaatatagcagggtaatgtaagatgataacgttagagaaactgaaactgggtgagggctatctaggaattctctgtactatcttaccaaattttcggtaagtctaagaaagcaatgc

SEQ ID NO: 124031 - DNA, 4287 bp, Homo sapiens
  Payload ID: 4352
  Gene Symbol: CRISPLD1
  Gene Name: cysteine-rich secretory protein LCCL domain containing 1
  Uniprot ID: Q9H336
  ENST ID: ENST00000262207
  CDS Start-End: 469-1971
ggcgcctggttctgcgcgtactggctgtacggagcaggagcaagaggtcgccgccagcctccgccgccgagcctcgttcgtgtccccgcccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatgtttgattccttgggaatggccttaaaaataaatgtaataaagtcagagtggtggtatgaaaacattcctagtgatcatgtagtaaatgtagggttaagcatggacagccagagctttctatgtactgttaaaattgaggtcacatattttcttttgtatcctggcaaatactcctgcaggccaggaagtataatagcaaaaagttgaacaaagatgaactaatgtattacattaccattgccactgatttttttttaaatggtaaatgaccttgtatataaatattgccatatcatggtacctataatggtgatatatttgtttctatgaaaaatgtattgtgctttgatactaaaaatctgtaaaatgttagttttggtaattttttttctgctggtggatttacatattaaattttttctgctggtggataaacattaaaattaatcatgtttcaaagttttattttcagttccttttgcatgcctattttgatttagaaatcactttaagataaatgaacaaaattattgtaagtcttctaaacttggtttattgacgttagtataaataacatacaataccagatgtctacaaaatcgacctgattatttaggtatttgtatgtgaaagagaaacacatatttagaaacacagcaagggagattttgaataaagagagagatgaatttataaagtaggaaaaaaagaatctgaaagatacaaagtgattataaaagaattgacaggacaataaatacttcaaatacttttaggaagtaaatgagtaggagtttaggagggataaacgagataaattccatgcaatgatcaaggaaagcaagagagcagataatacaaaagaaaaagaagaaggttcacataaatagcttctggagtgcaaattataaagacatcaacatttttgatcatataataagtactggcttacagctaagtggttccaaatactggtaattaaaacaatgatgtatacgttaaagattgcaaaacttaaaagcagatttttatgggaacttttttcgaaaggatacatgaccaccttcttaaatagtatgactttacatagactctttttctggtccttactgctcctcccacaacagggaagcccgatcagttctgtcagtataaggttttcttctatttgcccttagtttagatctccatcatcaattccacttactattgtaataccttcagctggagcctgtgtctttctccattcctttttaatacattcgtatttcccagccccagaacccttgaaattaactcttccatgagttttcattgctgaagaaaaaccaaacattcttgtaaaaacatttaagaacttccatagtcttgttcatattgtttacctatcttctacacaaggcgtgtccttgggtaagttatttaacttcaatttaccttacctgtaaaatggaacaaataatatctccttaagattgctctacgaattaattgacacattatgtgtgatgtacttaaaggaataataaatgcataatatgaggtcagtggacgccattttctgttataatcatttttgttatctaatttggggaaactattcatctgtcatatactattgatcctttggcacttaaataaatgtgaaatcctccaggaattttcctgtgattctccttgtaagaattaaatgctctctaatatgatatccctttaa

SEQ ID NO: 124032 - DNA, 1964 bp, Homo sapiens
  Payload ID: 4352
  Gene Symbol: CRISPLD1
  Gene Name: cysteine-rich secretory protein LCCL domain containing 1
  Uniprot ID: Q9H336
  ENST ID: ENST00000517786
  CDS Start-End: 421-1365
aaaggtgctgctggtaataaaacatgaaactatatcttatgcttggtcaagacgtgtcaaatctgtatctgaaatagtgaatgaatgagatcagatgttgtccagagaaggaaaatcaaatgataaaagtgttgagagaggggcagctcttgaaggaagatggaataagaacatggaaactcctgtgtggaaagaaaaggccaagaggtctgctaaatcaagagtactgtgaataaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatg

SEQ ID NO: 124033 - DNA, 2100 bp, Homo sapiens
  Payload ID: 4352
  Gene Symbol: CRISPLD1
  Gene Name: cysteine-rich secretory protein LCCL domain containing 1
  ENST ID: ENST00000523524
  CDS Start-End: 563-1501
agaacgctggacaatccagtaaaggtgctgctggtaataaaacatgaaactatatcttatgcttggtcaagacgtgtcaaatctgtatctgaaatagtgaatgaatgagatcagatgttgtccagagaaggaaaatcaaatgataaaagtgttgagagaggggcagctcttgaaggaagatggaataagaacatggaaactcctgtgtggaaagaaaaggccaagaggtctgctaaatcaagagtactgtgaataaacatgggatgtagagctggaaagatctgcagaatcctgggctgaaagttgcttgtgggaacatggacctgcaagcttgcttccatcaattggacagaatttgggagcacactggggaagatataggcccccgacgtttcatgtacaatcgtggtatgatgaagtgaaagactttagctacccatatgaacatgaatgcaacccatattgtccattcaggtgttctggccctgtatgtacacattatacacaggtcgtgtgggcaactagtaacagaatcggttgtgccattaatttgtgtcataacatgaacatctgggggcagatatggcccaaagctgtctacctggtgtgcaattactccccaaagggaaactggtggggccatgccccttacaaacatgggcggccctgttctgcttgcccacctagttttggagggggctgtagagaaaatctgtgctacaaagaagggtcagacaggtattatccccctcgagaagaggaaacaaatgaaatagaacgacagcagtcacaagtccatgacacccatgtccggacaagatcagatgatagtagcagaaatgaagtcataagcgcacagcaaatgtcccaaattgtttcttgtgaagtaagattaagagatcagtgcaaaggaacaacctgcaataggtacgaatgtcctgctggctgtttggatagtaaagctaaagttattggcagtgtacattatgaaatgcaatccagcatctgtagagctgcaattcattatggtataatagacaatgatggtggctgggtagatatcactagacaaggaagaaagcattatttcatcaagtccaatagaaatggtattcaaacaattggcaaatatcagtctgctaattccttcacagtctctaaagtaacagttcaggctgtgacttgtgaaacaactgtggaacagctctgtccatttcataagcctgcttcacattgcccaagagtatactgtcctcgtaactgtatgcaagcaaatccacattatgctcgtgtaattggaactcgagtttattctgatctgtccagtatctgcagagcagcagtacatgctggagtggttcgaaatcacggtggttatgttgatgtaatgcctgtggacaaaagaaagacctacattgcttcttttcagaatggaatcttctcagaaagtttacagaatcctccaggaggaaaggcattcagagtgtttgctgttgtgtgaaactgaatacttggaagaggaccataaagactattccaaatgcaatatttctgaattttgtataaaactgtaacattactgtacagagtacatcaactattttcagcccaaaaaggtgccaaatgcatataaatcttgataaacaaagtctataaaataaaacatgggacattagctttgggaaaagtaatgaaaatataatggttttagaaatcctgtgttaaatattgctatattttcttagcagttatttctacagttaattacatagtcatgattgttctacgtttcatatattatatggtgctttgtatatgccactaataaaatgaatctaaacattgaatgtgaatggccctcagaaaatcatctagtgcatttaaaaataatcgactctaaaactgaaagaaaccttatcacattttccccagttcaatgctatgccattaccaactccaaataatctcaaataattttccacttaataactgtaaagtttttttctgttaatttaggcatatagaatattaaattctgatattgcacttcttattttatataaaataatcctttaatatccaaatgaatctgttaaaatg

SEQ ID NO: 124034 - DNA, 553 bp, Homo sapiens
  Payload ID: 4352
  Gene Symbol: CRISPLD1
  Gene Name: cysteine-rich secretory protein LCCL domain containing 1
  ENST ID: ENST00000520277
  CDS Start-End: 239-553
agaaacgctggggcgcccaccctggcagactaacgaagcagctcccttcccaccccaactgcaggtctaattttggacgctttgcctgccatttcttccaggttgagggagccgcagaggcggaggccggccgtccggtttggctcacctctcccaggaaacttcacactggagagccaaaaggagtggaagagcctgtcttggagattttcctggggaaatcctgaggtcattcattatgaagtgtaccgcgcgggagtggctcagagtaaccacagtgctgttcatggctagagcaattccagccatggtggttcccaatgccactttattggagaaacttttggaaaaatacatggatgaggatggtgagtggtggatagccaaacaacgagggaaaagggccatcacagacaatgacatgcagagtattttggaccttcataataaattacgaagtcaggtgtatccaacagcctctaatatggagtatatgacatgggatgtagagctggaaagatctgcagaatcctgggctgaaagttgcttgtgg

SEQ ID NO: 124035 - DNA, 4586 bp, Homo sapiens
  Payload ID: 4353
  Gene Symbol: CRISPLD2
  Gene Name: cysteine-rich secretory protein LCCL domain containing 2
  Uniprot ID: Q9H0B8
  ENST ID: ENST00000262424
  CDS Start-End: 225-1718
cactcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcaccgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccatc

SEQ ID NO: 124036 - DNA, 808 bp, Homo sapiens
  Payload ID: 4353
  Gene Symbol: CRISPLD2
  Gene Name: cysteine-rich secretory protein LCCL domain containing 2
  Uniprot ID: Q9H0B8
  ENST ID: ENST00000569090
  CDS Start-End: 204-566
ccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtaagagccacaagttcctctccggctgccgcaggaccccactgccgtgtgccgggctcagcacttgtgccccttatcaagtttagcctgcaaagagagtgagagagaccacccgtcccatcgatattctgggaaactgaggcttggcatccaggaacactcctgagtgactgacaaaatgtattcaagcttggttggctgaccccagacactgatgattgattaaagtttgtagtttgggttttc

SEQ ID NO: 124037 - DNA, 538 bp, Homo sapiens
  Payload ID: 4353
  Gene Symbol: CRISPLD2
  Gene Name: cysteine-rich secretory protein LCCL domain containing 2
  ENST ID: ENST00000566151
  CDS Start-End: 483-538
actcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagattgggtcttatccccaagatatctcattatgtacatgcaaatcagcggagcatcgtcatgacaccaggaggacaccccgtgacgccgattaccgcactctcaacctcaacccagcgtcagagttttctggcatctcttctttgagcctggccgcctgcagctggaaatgctcatatatggtggtgtgactaacctgagagagagagatcagggatcctgagaagttctgcattcttggtctgcttcccagtgggacgaagctcaagcgcccagctctgcccgaggagcccaggctgccccgtgagtcccatagttgctgcaggagtggagccatgagctgcgtcctgggtggtgtcatccccttggggctgctgttcctggtctgcgg

SEQ ID NO: 124038 - DNA, 1123 bp, Homo sapiens
  Payload ID: 4353
  Gene Symbol: CRISPLD2
  Gene Name: cysteine-rich secretory protein LCCL domain containing 2
  ENST ID: ENST00000563066
  CDS Start-End: 495-1123
cgggaggcggggagtgaagaacaaagagccgttccggagacctgggaggcattgcccatgggtcagggctacactggttttctggctgggctttctgtctttctccaagctctggacacaccgcaccgtgagaaaggctcctggaagcagagcaaccctgcccgggggctgtttctgaaggggcagagcagaggctggaaaacctgcaagccttccctcagagtcactgcgttccctcgtgccacgctcccctcctcttccaaacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgt

SEQ ID NO: 124039 - DNA, 2178 bp, Homo sapiens
  Payload ID: 4353
  Gene Symbol: CRISPLD2
  Gene Name: cysteine-rich secretory protein LCCL domain containing 2
  ENST ID: ENST00000567845
  CDS Start-End: 218-1708
atcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatt

SEQ ID NO: 124040 - DNA, 615 bp, Homo sapiens
  Payload ID: 4353
  Gene Symbol: CRISPLD2
  Gene Name: cysteine-rich secretory protein LCCL domain containing 2
  ENST ID: ENST00000566789
  CDS Start-End: 281-615
tccgcctcctcggcctccctccctcccggctgcccgtggctgctcctggaattggccgctattcaccctcctcggcctccctccctcctacctgcccgtggctgctgctgtctccactggtgggtgaggggaggggctgggactgagtgagcggtttctgccctgcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggt

SEQ ID NO: 124041 - DNA, 1651 bp, Homo sapiens
  Payload ID: 4353
  Gene Symbol: CRISPLD2
  Gene Name: cysteine-rich secretory protein LCCL domain containing 2
  Uniprot ID: Q9H0B8
  ENST ID: ENST00000564567
  CDS Start-End: 206-1555
ctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatgtgagtaggatgcattttcaacaactatctcgcaaagcctgttaaagacctcaacatgcaagctccaagatctggatacttgaaactttattccagtgcctcttagctaaattaattaattaattaattaattaatttcga

SEQ ID NO: 124042 - DNA, 590 bp, Homo sapiens
  Payload ID: 4353
  Gene Symbol: CRISPLD2
  Gene Name: cysteine-rich secretory protein LCCL domain containing 2
  ENST ID: ENST00000566165
  CDS Start-End: 1-130
caagacagccgtgcacgcgggagtcatcagcaacgagagtgggggtgacgtggacgtgatgcccgtggataaaaagaagacctacgtgggctcgctcaggaatggagttcagtctgaaagaaacatgtaaatcaaaccacaggatgaagttgacatttgcttgcagctcttgggccttttaaaaaataagaggagttccttttcctggcttcgaaaaggaacagcagtggtgatcataatggtcatcagaggagaaccatcccagcaacccagccacagctggtcttcactggacaccatgaactacaccgtccaaaccttcttcactcccgccaacagcagccgttcccctaactataagatgctcaaggaggagcaagaggtggctgtgctgggggcaccccacaaccctgctcccctgacgtccacgtgatccacatccacagcgagacctctgtgaccgaccatgtcatctggtccctgtttaacaccctcttcatgaactcctgctgcctgggcttcatagcatttgcctactccgtgaagtctagggacaggaagatggttgacgacctgaacagggcccaggc

SEQ ID NO: 124043 - DNA, 1297 bp, Homo sapiens
  Payload ID: 4354
  Gene Symbol: CYSRT1
  Gene Name: cysteine-rich tail protein 1
  ENST ID: ENST00000409414
  CDS Start-End: 488-1042
cttgaacccgggaggcagaggttgcagtgagccgagatcgcgcagctgcactccagcctgggcaacagagcaagactccatctcagaaaagaagcagaaagcctccaagagccaatggctctcaagcatcttggtctctgctaagaagaggctcagaggcttagaagccctgcctcgccggggctttgaggtgtgtgagcaatggctggggactgcaggcccgggaatctgagggcctcaccccacttcctttccagagccgtgacctcaggctcacctcctgccctcctctcaggcaagctgcagatgccctttagggcccaggccatgccccggatgtgaggggctgagtcactggtttggcagtgcccctcagagcccaggcctgggctgccacccacctgaggacgagggctgggccagctgtcgtgctccagttgctggggcctcttgggatcttgggaaccccatctctgagccccgccccatggccccgcccctcccaaggagggaaaaggcggctgccagtcgctcaactcaggcactgggacctagagctcagaagaccgagaggacagactgccgtgttgccaccacaggctggaccatggacccccaagagatggtcgtcaagaacccatatgcccacatcagcatcccccgggctcacctgcggcctgacctggggcagcagttagaggtggcttccacctgttcctcatcctcggagatgcagcccctgccagtggggccctgtgccccagagccaacccacctcttgcagccgaccgaggtcccagggcccaagggcgccaagggtaaccagggggctgcccccatccagaaccagcaggcctggcagcagcctggcaacccctacagcagcagtcagcgccaggccggactgacctacgctggccctccgcccgcggggcgcggggatgacatcgcccaccactgctgctgctgcccctgctgccactgctgccactgcccccccttctgccgctgccacagctgctgctgctgtgtcatctcctagcccagcccaccctgccagggccaggacccagacttcagcaaatgtggctcacacagtgccgggacatgccgggacatgcggggtggctgttgtcatgggcgtctgccccttcacaccaggcactggggctcagacccaccaggaaggtggccgttcagcccgagctcctgaaacggaatcccaggtcctggctggagagggacacccctgattaccttaaggcccaggcaataaagcagggtgatcttcctccca

SEQ ID NO: 124044 - DNA, 1336 bp, Homo sapiens
  Payload ID: 4355
  Gene Symbol: CYSTM1
  Gene Name: cysteine-rich transmembrane module containing 1
  Uniprot ID: Q9H1C7
  ENST ID: ENST00000261811
  CDS Start-End: 665-958
tactggcgggactacttgttgcaaggtttatggggaaaagtagccagagagcaatccagttatcagcctcagccccattccgctcaggtacagctcgggaagtaagcccccaaccctagttgggtctggaccaacaagacacgaggaggcagcagcccacagccgacccctcatgccacgcactgagcagggttccgcatggacgctggtcttgcctcccaggcgcctgaactagcggagttggggtatcgggtggagtctcggagaaccaatccaatctgagggggacgcctgtgggagtcctaagtatccagcgcagctgggaggcccacgttgggaagtcggagaccgaccccgcctcccgactgcgccgactgcaagagagcgcttccggcggcgcttggaggccgagcagttgggggcggggctcgtgctgtgacgcaagcctcgcctcgccccgcgccgcgcgcgttgccagggtgatcaggtgactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgatgaaccaagagaaccctccaccatatccaggccctggtccaacggccccatacccaccttatccaccacaaccaatgggtccaggacctatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgggacatgctcacctgaccagaccagcccagccgtcctgtcctgccagctctgctgccacctctgacaggtgtgcctgcccccatctcttctgattgctgttaacaaatgactagctttgcacagacacctctaccttcagcactatgggattctagattaatgggggttgctactgtttaattcagtgacttgatctttttaatgtccaaaatccatttcttattgatctttaaagatgtgctaaatgacttttttggccaaaggcttagttgtgaaaaatataatttttaaattatacattcaaggtagtggccaaatgtaacacatcaatcatggaatgatttctctgctaacagccgcctgtatgtttcaataaatttgtccaaagctcaa

SEQ ID NO: 124045 - DNA, 1994 bp, Homo sapiens
  Payload ID: 4356
  Gene Symbol: CRELD1
  Gene Name: cysteine-rich with EGF-like domains 1
  Uniprot ID: Q96HD1
  ENST ID: ENST00000326434
  CDS Start-End: 85-1353
aggagacggcccacggcgcccgcgggctggggcggtcgcttcttccttctccgtggcctacgagggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 124046 - DNA, 2696 bp, Homo sapiens
  Payload ID: 4356
  Gene Symbol: CRELD1
  Gene Name: cysteine-rich with EGF-like domains 1
  Uniprot ID: Q96HD1
  ENST ID: ENST00000383811
  CDS Start-End: 600-1862
tggcagcgacgcggtgaggagacggcccacggcgcccgcgggctggggcggtcgcttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgaggtgacaaatgtgaagacctggacagtacacaacagatattcaataaaagtgtggtcgccattatgaccagagcctccaagcctcaa

SEQ ID NO: 124047 - DNA, 1728 bp, Homo sapiens
  Payload ID: 4356
  Gene Symbol: CRELD1
  Gene Name: cysteine-rich with EGF-like domains 1
  Uniprot ID: Q96HD1
  ENST ID: ENST00000397170
  CDS Start-End: 51-1313
tgcgttttacgcaggctgtggcagcgacgcggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttatt

SEQ ID NO: 124048 - DNA, 1778 bp, Homo sapiens
  Payload ID: 4356
  Gene Symbol: CRELD1
  Gene Name: cysteine-rich with EGF-like domains 1
  Uniprot ID: Q96HD1
  ENST ID: ENST00000452070
  CDS Start-End: 96-1358
gcgacgcggtgaggagacggcccacggcgcccgcgggctggggcggtcgcttcttccttctccgtggcctacgagggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatct

SEQ ID NO: 124049 - DNA, 966 bp, Homo sapiens
  Payload ID: 4356
  Gene Symbol: CRELD1
  Gene Name: cysteine-rich with EGF-like domains 1
  ENST ID: ENST00000435417
  CDS Start-End: 1-301
ccctgctcacctctctgcagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcagatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaa

SEQ ID NO: 124050 - DNA, 723 bp, Homo sapiens
  Payload ID: 4356
  Gene Symbol: CRELD1
  Gene Name: cysteine-rich with EGF-like domains 1
  ENST ID: ENST00000414117
  CDS Start-End: 21-326
ggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagcctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctgcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcggtg

SEQ ID NO: 124051 - DNA, 1357 bp, Homo sapiens
  Payload ID: 4357
  Gene Symbol: CRELD2
  Gene Name: cysteine-rich with EGF-like domains 2
  Uniprot ID: Q6UXH1
  ENST ID: ENST00000328268
  CDS Start-End: 75-1136
gcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaa

SEQ ID NO: 124052 - DNA, 1577 bp, Homo sapiens
  Payload ID: 4357
  Gene Symbol: CRELD2
  Gene Name: cysteine-rich with EGF-like domains 2
  Uniprot ID: Q6UXH1
  ENST ID: ENST00000404488
  CDS Start-End: 136-1344
gggcctcgccggcgccgtcaagtagcctgggggacaggccggcgcggctgggagcgggtgggcggccgggaggccggagcagcacggccgcaggacctggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagtcaggaccggcctctccgattcttacccgccttgctgtctgtctcttggatgttggcgtggcgtgggccacgcatggatccgtggccggaacacgcacacccagccaggctacagctccagagtatggatagctgccttctctccagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcaggaggagaa

SEQ ID NO: 124053 - DNA, 1242 bp, Homo sapiens
  Payload ID: 4357
  Gene Symbol: CRELD2
  Gene Name: cysteine-rich with EGF-like domains 2
  Uniprot ID: Q6UXH1
  ENST ID: ENST00000403427
  CDS Start-End: 38-1015
ggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggagtgtgactccagctgtgtgggctgcacaggggaaggcccaggaaactgtaaagagtgtatctctggctacgcgagggagcacggacagtgtgcagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcagga

SEQ ID NO: 124054 - DNA, 1230 bp, Homo sapiens
  Payload ID: 4357
  Gene Symbol: CRELD2
  Gene Name: cysteine-rich with EGF-like domains 2
  Uniprot ID: Q6UXH1
  ENST ID: ENST00000407217
  CDS Start-End: 38-1003
ggagctccggctgcgtcttcccgcagcgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtggatgtggacgagtgtgcggccgagccgcctccctgcagcgctgcgcagttctgtaagaacgccaacggctcctacacgtgcgaagatgtggacgagtgctcactagcagaaaaaacctgtgtgaggaaaaacgaaaactgctacaatactccagggagctacgtctgtgtgtgtcctgacggcttcgaagaaacggaagatgcctgtgtgccgccggcagaggctgaagccacagaaggagaaagcccgacacagctgccctcccgcgaagacctgtaatgtgccggacttaccctttaaattattcagaaggatgtcccgtggaaaatgtggccctgaggatgccgtctcctgcagtggacagcggcggggagaggctgcctgctctctaacggttgattctcatttgtcccttaaacagctgcatttcttggttgttcttaaacagacttgtatattttgatacagttctttgtaataaaattgaccattgtaggtaatcagga

SEQ ID NO: 124055 - DNA, 963 bp, Homo sapiens
  Payload ID: 4357
  Gene Symbol: CRELD2
  Gene Name: cysteine-rich with EGF-like domains 2
  ENST ID: ENST00000450207
  CDS Start-End: 276-963
gcgccagcgccagctcgggtcgcgccctcgcccgcctcctccctggtctcgccgcgcgcccgcctgaaggccccggtcgcggcagcgcgcactgacctccgcagctcccggcggcgtccttcgaagcgcggctgcctgggccagcctcggcaggaagcaggacggcggaaacagaacagagcccgaatctaaagtccttgcccaaatctaaagtggctaccgcagccccggccgctacggccgcagagaccctctgtgccctgacgctacccgccatgcgcctgccgcgccgggccgcgctggggctcctgccgcttctgctgctgctgccgcccgcgccggaggccgccaagaagccgacgccctgccaccggtgccgggggctggtggacaagtttaaccaggggatggtggacaccgcaaagaagaactttggcggcgggaacacggcttgggaggaaaagacgctgtccaagtacgagtccagcgagattcgcctgctggagatcctggaggggctgtgcgagagcagcgacttcgaatgcaatcagatgctagaggcgcaggaggagcacctggaggcctggtggctgcagctgaagagcgaatatcctgacttattcgagtggttttgtgtgaagacactgaaagtgtgctgctctccaggaacctacggtcccgactgtctcgcatgccagggcggatcccagaggccctgcagcgggaatggccactgcagcggagatgggagcagacagggcgacgggtcctgccggtgccacatggggtaccagggcccgctgtgcactgactgcatggacggctacttcagctcgctccggaacgagacccacagcatctgcacagcctgtgacgagtcctgcaagacgtgctcgggcctgaccaacagagactgcggcgagtgtgaagtgggctgggtgctggacgagggcgcctgtgtgg

SEQ ID NO: 124056 - DNA, 2290 bp, Homo sapiens
  Payload ID: 4358
  Gene Symbol: CYR61
  Gene Name: cysteine-rich, angiogenic inducer, 61
  Uniprot ID: O00622
  ENST ID: ENST00000451137
  CDS Start-End: 225-1370
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaa

SEQ ID NO: 124057 - DNA, 1364 bp, Homo sapiens
  Payload ID: 4358
  Gene Symbol: CYR61
  Gene Name: cysteine-rich, angiogenic inducer, 61
  ENST ID: ENST00000617517
  CDS Start-End: 225-1364
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggtgtgaagatgcggttccgctgcgaagatggggagacattttccaagaacgtcatgatgatccagtcaaatgcaactacaactgcccgcatgccaatgaagcagcgtttcccttctacaggctgttcaatgacattcacaaatttagggactaa

SEQ ID NO: 124058 - DNA, 1875 bp, Homo sapiens
  Payload ID: 4359
  Gene Symbol: CDPF1
  Gene Name: cysteine-rich, DPF motif domain containing 1
  Uniprot ID: Q6NVV7
  ENST ID: ENST00000314567
  CDS Start-End: 425-796
gcagcctagtccgcggcgcgggagggcaggtgggagactggaggcgccctcgcgcccctcagctatccgggagcctcgcgccggcgacctcgaccctgtcgaacccggcggaacactcagaaagaagctgagcgcctcgcagcggccaggacagcgggccaggcccgcgcgctcccgcagcgcacggccagacgcgacgcccctcagcacggaacccagcctcgcggactaccccgaagctcagagccacatcccgcgcagaggaccgcggcgaccggaaaagcaaggcagaggcggaaaaccaccgcgaggtcccgcctcccgctccgcgcctgcgtctgcggctgcaccggggttggccgggccgcggtggggcggggccgctcaggcgccttggacgcggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 124059 - DNA, 1600 bp, Homo sapiens
  Payload ID: 4359
  Gene Symbol: CDPF1
  Gene Name: cysteine-rich, DPF motif domain containing 1
  ENST ID: ENST00000381037
  CDS Start-End: 35-304
gccttggacgcggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccgatgttcttggagggatctccaggagaagggactgtcctttcatgagcacttgttgtgtgccaggtcctgtgcttgggacctgttttactgctgaggcttcattcagtcctgccccttagtcaggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactga

SEQ ID NO: 124060 - DNA, 1439 bp, Homo sapiens
  Payload ID: 4359
  Gene Symbol: CDPF1
  Gene Name: cysteine-rich, DPF motif domain containing 1
  ENST ID: ENST00000404583
  CDS Start-End: 2-358
gatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgcact

SEQ ID NO: 124061 - DNA, 1541 bp, Homo sapiens
  Payload ID: 4359
  Gene Symbol: CDPF1
  Gene Name: cysteine-rich, DPF motif domain containing 1
  ENST ID: ENST00000404744
  CDS Start-End: 2-349
gatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggtggatgttcttggagggatctccaggagaagggactgtcctttcatgagcacttgttgtgtgccaggtcctgtgcttgggacctgttttactgctgaggcttcattcagtcctgccccttagtcaggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcac

SEQ ID NO: 124062 - DNA, 3148 bp, Homo sapiens
  Payload ID: 4360
  Gene Symbol: CSRNP1
  Gene Name: cysteine-serine-rich nuclear protein 1
  Uniprot ID: Q96S65
  ENST ID: ENST00000273153
  CDS Start-End: 179-1948
cgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 124063 - DNA, 2593 bp, Homo sapiens
  Payload ID: 4360
  Gene Symbol: CSRNP1
  Gene Name: cysteine-serine-rich nuclear protein 1
  Uniprot ID: Q96S65
  ENST ID: ENST00000514182
  CDS Start-End: 107-1876
gggcaggagagcattccagtcgagaagaccggctgcagtaaaagcgtgagggtggaaacgctcgaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaa

SEQ ID NO: 124064 - DNA, 4471 bp, Homo sapiens
  Payload ID: 4361
  Gene Symbol: CSRNP2
  Gene Name: cysteine-serine-rich nuclear protein 2
  Uniprot ID: Q9H175
  ENST ID: ENST00000228515
  CDS Start-End: 299-1930
cgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccgaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaagatattgatgtggaaaatgtggaggtggatgattacttcttcctgcagcctctgcccaccaaacggcgacgggccctgctgagggcttctggggtccaccgtattgatgctgaagagaagcaagaacttcgagccatccgcctgtcacgggaagaatgtggttgtgactgccgactgtattgtgacccagaagcgtgtgcctgcagccaggctgggattaaatgccaggtggatcgcatgtcctttccatgtggctgctcccgggatggctgtgggaacatggcaggacgcattgaatttaatccaatccgggtccggactcattacctccacaccattatgaagctggagctggagagcaagcggcaggtgagccgcccagcagccccagatgaggagccctccccgactgccagttgcagcctgacaggagcacagggctctgagacccaggacttccaggagttcattgctgagaatgagacagcagtgatgcacctgcagagtgcagaggaactggagcggctcaaggcagaagaagattccagcggctctagtgccagcctggactcgagcatcgagagcctgggtgtgtgcatcctagaggagcctctggctgtccccgaagagctgtgcccaggccttacagcccccattctcatccaggctcagctgcccccaggctcctctgtcctgtgttttaccgagaactcagaccacccaactgcctcaacggtgaacagcccatcctacttgaacagtgggcccctggtctattatcaagtggagcagaggccagtcttgggagtgaaaggagagcctggtacggaagaaggctcagcctctttcccaaaggagaaggatctgaatgtcttctctctccctgttacctcactcgtggcttgtagctccacagacccagctgccctctgtaaatcagaggtggggaaaacacccaccctagaagctctattgcccgaagattgtaaccctgaggagcctgaaaatgaagacttccacccttcctggtccccctcaagcctccccttccgcacggacaatgaagagggctgtgggatggtgaagacctcccagcagaatgaggatcggccccctgaagattcttccttagaactccctctggcagtgtgacaggcgctagaggtcctgcctcttacccattctctatttattcccttattttatctaacaccatttcaaaacaaaactgtagaagcagctgctgctcccatgttattttattggggtctttggggaatgggtgggaaaggattgtttgagtattttttaaaagggaaacagtaccaaggagaccagccctaccttgatctggggatagtcttggggcaaagaaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacctgccttccttcaatcccatatttggtaaataagttaatatttgacatgtttggtgttctctgacctgttccccacactggggattcctggtctgtaacttgaattgtttcttccacatgttcttaagtactagagttaaacttgtctatgtgtcttttttctctccatcctttttccttcggagaaagagctggattggctggggatatggtataacgagcctgagccttctgtacgtgtctgacactagcactgtcaggcagctttcggctggggctcacccatcccataggaggcctatgtggagcattaactgtggccaaaggaggcagcgggaacaggctgcttgctatctggaaagatgacatatttgtgccatgcttgttttttcacccaggtttttccctctttgtgagatctgagctttagtggaatgtagaatgtggcaatcttaaggtcaccaatcagtttttgttcttttttcctggatctaccctcatggtcgttttcaacatagcgggttagagttcttatactgttccagttcaattccaagaattgcaaatgtttattggacccctccatcttgatgatatataaaaattggaagccaaaccagttcttaaatgctacatgcaactcccagattccaaaggattcaagttctaattataacctttgaagcgtatagaatggaactcattcagtttgattcagttcttacctctgtcaggaggaatacagttcctgttcatcctgtgttctaagatctccattgaacagcactgatttcctttcattagcaaagtgatctttgtctctgttctaaaatggaggcagtagggagcaaaactattcttctcaagcatcctttacaccatactttacttctggtatggtttattaaccacacacacacacaaaagtgaaaaactgtgttgggggggagacactactcctacttatcttgctcataaagccttttctggtgggatattaaggccctggtgtcttacagaaaccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctagataaatgactcttattaccacaacccttattattttccaatttcctttctcacatactgtacacaggtagtattttcaatgtgaatccaaagcttgtctggttctctgaaaataattttttcccctttaggttctttacattgtgataatgctgtatttaaagagaatatttaaatgtaatattaaagaaatattcaaaagaa

SEQ ID NO: 124065 - DNA, 449 bp, Homo sapiens
  Payload ID: 4361
  Gene Symbol: CSRNP2
  Gene Name: cysteine-serine-rich nuclear protein 2
  ENST ID: ENST00000552899
  CDS Start-End: 191-449
actgcgggggcagctcgcgggagaccgatgggcggcttggaagcctgcaggattgcagatgaggattgagttcggaatggagtggagaatgatgtaggatggagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgccca

SEQ ID NO: 124066 - DNA, 845 bp, Homo sapiens
  Payload ID: 4361
  Gene Symbol: CSRNP2
  Gene Name: cysteine-serine-rich nuclear protein 2
  ENST ID: ENST00000548981
  CDS Start-End: 502-845
aggacgtgccggcgcctataagagccagtgcgctgcggccggatcctattgttagccggagccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggagggaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacagga

SEQ ID NO: 124067 - DNA, 685 bp, Homo sapiens
  Payload ID: 4361
  Gene Symbol: CSRNP2
  Gene Name: cysteine-serine-rich nuclear protein 2
  ENST ID: ENST00000548206
  CDS Start-End: 486-685
ccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggtaatgggcctaggggtgcggggcggagggtgccgcctcgtcctttctcgggatcggccctcgggcggccgtggaggagtggtcaagcccagagccgtgcggatggagggccacatccatcctgaagcggcagaagcagctgcggaggaagaatgtacgctttgaccaggtgactgtatactactttgcccggcgccaaggttttaccagtgtgcccagccagggtggtagctctctgggcatggcccagcgccataactctgtacggagctatacactctgtgagtttgcccaggaacaggaggtgaaccatcgagagattctgcgtgagcacctgaaggaagagaaactccatgccaagaaaatgaagctgaccaagaatgggacagtggagtcggtggaggctgatggcctgacgctggatgatgtgtcagatgaaga

SEQ ID NO: 124068 - DNA, 681 bp, Homo sapiens
  Payload ID: 4361
  Gene Symbol: CSRNP2
  Gene Name: cysteine-serine-rich nuclear protein 2
  ENST ID: ENST00000546935
  CDS Start-End: 506-681
gccggggcggttctgggcgtctgctgccgggggcgcccgagttgccggagacgcccggccctctctgcctgccggctgggctgcccaccgccctccctccccgccctgccgccctgggagctccccggccgtcgccgcggggcccgggactcgctcgctcctccctccttcccaccgggctagggcggcggcggcagcgggggcggcagagaccatcacgggaggaggcagctgcggcggggccggcccaattacgcagccaactgccacccgtcccttttagtgctgtggtcttgattcatccttttaaaggggttgagagtggcagtgtgacacacaaactgttcttcagaatgaaatgctagaagttatccccacaagacaacactgtccccttgtcctgcagttttcagttcaagaatcctaatgtacctggctagctggtggtgagtaggggctttggggccaacttggtgggctccccaaggaaacccctttgaaaccaatggatgcattcacgggctcgggtctcaagaggaagtttgatgatgtggatgtgggctcatcagtttccaactcagatgatgagatctccagcagtgatagtgctgacagctgcgacagcctcaatcctcctaccactgccagcttcacacccacatccatcctgaagcggcagaa

SEQ ID NO: 124069 - DNA, 11788 bp, Homo sapiens
  Payload ID: 4362
  Gene Symbol: CSRNP3
  Gene Name: cysteine-serine-rich nuclear protein 3
  Uniprot ID: Q8WYN3
  ENST ID: ENST00000314499
  CDS Start-End: 377-2134
attggttggctgccgcctgatggatagacgagggaggagtgtactctcttcagtgtgttctgacggagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttgagatgaaaaaatttaaaaaaaaattaaaaagatctttaactattataaggttcatataattaatatagaggaatcatccaatgatacttatgaagggaaaatgacctattttccttcaccactctgaggacctaactcagtaaatgcagaggaggctgaggaaacatggaagagacacgacctcagcaaccagccttttctccagcgtgatcaatccatctctacaaaatcagtgtataatgagatttccacttagtgactagctgattgaaggggggcctctacccaaatactcaactaggcctttcttttctgaagcattttgatttgtcttgcctgggacaactagcagaacagtccagaatgcattgcatactttctaattacctcacattctcttattaaagagaacagatagaaataaaacatgcactccccacctttagattacctgcacttggttcgtcggaggacttctaggatcccgtttccctgtaaattaatttaggtaactaaatagtgtaattctgcctttttttttccaatgcaatatgactatgctaaacctgtttcatatttttgaccttctattgttatatcacttcacatgttttataactatttgaaatgcggacatgacttgctattcagtgactgcatcgctacttattttttatgtcttttagacttgggtgtttagaattatggatataaatatattgtagatctcaatttctaaaaaaaatattttatttaattgaacttaaaaatgcttgatctagagaaagtcctccagtggaaaagtttctactaaactttgttttggggaaaaaatgtttacttggcagctcttccactgtgcagttggtttctgccccttctcttcccccctacattgggccaaatttataactcttaatattaacattaaaagagctttgggtttgtctttatgtaggttgcagtaatgagagcagggttgttccttttgaatgattggccctttgggctaatcagaatgaggatttgttgaaatctcaaatatacatatatatatatatatatatatatatatatatatacacacacacacacacatacacatatatatacacatatatgtatgtgtgtgtgtgtgtgtgtgtgtgtgtatatatatatatcccatgttgtctgcaaagtgacagtttttagtgcttaatctccaaaattttccccctactgatacaatctaaagagcacaggcccaaagagaaaatgacaagaggctattgttccttcattcaagcacatgaaaggatcatgtgtactgtatttgctggaccattacaagctcttgaaggatctgcttgtgaagtactctgaggttattcttggaacacagagtgtgggagagtggggaagagccagctccagcctgagcaaagctgaagggtagaatgacagtccagtttctgaaaagagatattttaattttagttcagctttattttcctaagacgatatgaagcctacttttttatttttggctaggtctttgttttctagctttgtttccaaaaggatgcttaagaaaacagagtttttttcccctatccatttatctagggtagaaagtcactgccctgtgagaagaattacccttccaatcatgacagcttctattccaacttttcatatacctgactaacctgtaaacatatcccacaaaccacatacacaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttaaaaatggggatcaagctacatgcagccagttggaatacttaagatctttatgccaagacacaataacctgacctgcagctgttgtattgcctccatagtatatctagccaaactgtagtctttgacacacaactttttagtcattcactatcaattgcaaagcttcatgctccagccctggctattctagtaccagtcctatacctttaaatgggacttaattcccagttataatcctggccgaattgatttgaaagtcaagtggctgaagcagcttgcatctcctttgtcattcccaatttcctttgggagaagtcaatgaaagagatttacttaagtttttcctccttatctcttgatcattaattattaagacatgggtaaaattcatttgtctcatgtcttttggttgattgaataatatagttactttttgaaagcccatcatttctttgtgataaaaccattttctcaatgtgacagccacatgtaaaatgtgaaactaatgtttcttagtatgtttaaaatcttcacaatcatatatggccctgcaatactccctgaattccttccctccaaaaaaaaactatgagttgcaaaaacactagttacgaattaatcaagaagcaaagagagtatgttaagtggctatgttctttaaaattttacattctaatagatgacttctaggcaaaattttggtatgattaccattaaacaggaaaacataccatgatttactttctataacttgctaatcactgtttcttttatttcaatttttgatattgttgcacaagtttatgactctttggtctttatattcaaaatttattaagtatcaattctttctttcaacaaatatgtactgaacacatgctgtgttagaacaactgtcttgggtagtaaaaagaggggaacactacaaattataatggataatattaatgaagggtggcatgaaataatcaagctttctcaaatcctcttaatatgtgattttatcaagtgacattagaaaaactgacatcagttcttgtctaattatatgtgagctgcaactaaaagatgcttcctttacctaaattatagaactcactggatcgcccttcatctctctccctccatctgaaatgtatgaattaaatcaggactcagctaggactgaatcaaatgaaaaagaaattttcgattaattgcttcttcaatgttagacctatataagtgatgctaaatttacaccagcaaactcctatcagacagtttcaaggaggatttgactcatgcataacccaggaaacatttcaggaaacttttaagacaacagtgtggaacacaatcactcttacttctatttataaaaagcctatcaaaacagcaaaatcctgttgcaaattccaaagacatcactttgcagcaggtggaaaacagagaggttgttagactccatcactttcagctggagttacaaaccatcaaattagcaggtggaaaatttatattctcagaagccaacaggagactgcctttttaaaaggtgtcatgaagccttctatttctccaaacaactcaatatttctctttaaaatggcatctctgttccttattctcttgatgacagtttgcagtgccattatagccagtgtattaaataccaggctttaatgggaagcacctttgtgctttcaaaggcaagacttgtctgtaattttaaattagaactgttggttgtattcttaccacaaccaaaacccaaagtttaaaggcttgattactctatattaggtctaatatgaattttcaccttctgattgcattactttttctgaaatctgctaactagtgctggaataacaaaaatgcctaagccaaaatgctgtagctctgcaccaacagcacagctcatcagatgttttctatagtagtaaagaatttgattgacttaattgaatatcagcaattttaatacccactagaattatggaagtatcagagtggaagtgaggacgcaataaaagcttaataagtggtggtgtcttctaggaattatgaaaaaaaaagctcagcagagctaagccagatcttattacatcataaagactagagttacaaatggcagccccaaacctagaaggggcagttacaatgtggacaccctttcagcccagttggtgctcacatctgctgaccaacattcatatcaattacatttttacagtctgtaagtcatttgatgctttagaaaataaaaacacacacctacagcattctaaagaaactattttgttaaaaaatttaaacacattttatattaaaataagtgatcaatgactttcatgattgtcaaaagtaaaaagtgcagacatttaaaaaagctcttctttcacattttacctaccaaatctagatattcaacgtgagtccttaaaacagtcacttctaaattttattttgactcctttcttggctttttcaaactggaccatgagacccccttcctaaacaatgcagttgttttgttttattctttttttccagaaattcaagctgaaacatttgatatgacctgtgttttacctggtgatcagttctcaggctagtctaagtctgtgctgtcttggcatgccttgggtttcctatcctgagagtggtaatgccagtagaatgatgggaaccaggagagtgaatacgaccagattcaaagcctaaaacaatatgtttcagtttacttttatatgtagattttttaaatattcacatctagcctggaattttagtaaatacagatacttgttgtatccatgggaaatgaggtcatttcaaagatgtaagtcacgttggtgactactttcttttacttgtgataaatatatcactatacagggtaattgcttttataaatttgatcctttgcattggcttataattcaagaaatgtcaacttcactgtgtcactttatgtcatctctcataaaagtttctggcaggactaaagtttcaaaggaatgtgatagaatttattttggataacatttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggggacctatggaaaaggagtttgaaatttctacctttgtagtacattgtatccaattttgttttgctcctccttttcatgtggtcaccaagcttttttccttagccattaaaaaagccacccctctttaaaacaaatttaaagatctatatacatttttgcaactttatttaataaaaaagagaagaaaaaataaaatctaaatctcaattaccctaaagtggaaaaacctaagtatctaacctaggaacttgttgcctggtggtggttgttgttgttgttgttttttaatttatttagtgttgatccttgagttatttaatggtatccaaatgatatctgaaagtgattgattttaagatgtaatagttggcaaagtcatttcatttgtgtctcaaacaaataaagcccactgccatgggttaccatctgaaccctgattcattaggcactagtcatgccaaatggggatctcagaatagtttaatcttttcaaagatactcacaatggccaactgtgtgtgaatactggaaagtttgagattcttctatattcttcaaatttatggtcctgagactaggagggatctccagaggtcatatggctcatcgatctaccaccagggaagactgtcacttaggcatgcccaacaggagagatcgccatctattcttaacatctctagggaaggcagtttccttggcaacacaattcagctctcttaggttttctcacaataagaaaatatcttggccagtctttgagggttaggcacctggcaacagttgtggtgatttgggccattgtactaggggattcaagggaagttgggtttccccctacatttggtgattattacattaatatatgatcattccataagtctcctaagaaatcagatttttaaagaaagacacggattcagagacaatggtctgtaacatgaccaacttttgacaaatatggctgtactaggttttcatttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaaaggacttgggtgttatccttcagtctgtgttgaaccattcagatattgggaatggtccttacacaagggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgta

SEQ ID NO: 124070 - DNA, 11684 bp, Homo sapiens
  Payload ID: 4362
  Gene Symbol: CSRNP3
  Gene Name: cysteine-serine-rich nuclear protein 3
  Uniprot ID: Q8WYN3
  ENST ID: ENST00000342316
  CDS Start-End: 273-2030
ctcagtgaggctgatgccgtgcagcaagcagtaggtaatgagtctttgtgcagagtgaagctcttgttgctgaacaataaagcatatggtacaagcaataaaacacagggctgggaaatttaagaagattcctctgaaccaggaagaactgtgtcttcggtgatgctgacacatatgataaaatgatcatttattttggatcctaatgaataaagagtgcaaggactaagactacagttatttgaacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttgagatgaaaaaatttaaaaaaaaattaaaaagatctttaactattataaggttcatataattaatatagaggaatcatccaatgatacttatgaagggaaaatgacctattttccttcaccactctgaggacctaactcagtaaatgcagaggaggctgaggaaacatggaagagacacgacctcagcaaccagccttttctccagcgtgatcaatccatctctacaaaatcagtgtataatgagatttccacttagtgactagctgattgaaggggggcctctacccaaatactcaactaggcctttcttttctgaagcattttgatttgtcttgcctgggacaactagcagaacagtccagaatgcattgcatactttctaattacctcacattctcttattaaagagaacagatagaaataaaacatgcactccccacctttagattacctgcacttggttcgtcggaggacttctaggatcccgtttccctgtaaattaatttaggtaactaaatagtgtaattctgcctttttttttccaatgcaatatgactatgctaaacctgtttcatatttttgaccttctattgttatatcacttcacatgttttataactatttgaaatgcggacatgacttgctattcagtgactgcatcgctacttattttttatgtcttttagacttgggtgtttagaattatggatataaatatattgtagatctcaatttctaaaaaaaatattttatttaattgaacttaaaaatgcttgatctagagaaagtcctccagtggaaaagtttctactaaactttgttttggggaaaaaatgtttacttggcagctcttccactgtgcagttggtttctgccccttctcttcccccctacattgggccaaatttataactcttaatattaacattaaaagagctttgggtttgtctttatgtaggttgcagtaatgagagcagggttgttccttttgaatgattggccctttgggctaatcagaatgaggatttgttgaaatctcaaatatacatatatatatatatatatatatatatatatatatacacacacacacacacatacacatatatatacacatatatgtatgtgtgtgtgtgtgtgtgtgtgtgtgtatatatatatatcccatgttgtctgcaaagtgacagtttttagtgcttaatctccaaaattttccccctactgatacaatctaaagagcacaggcccaaagagaaaatgacaagaggctattgttccttcattcaagcacatgaaaggatcatgtgtactgtatttgctggaccattacaagctcttgaaggatctgcttgtgaagtactctgaggttattcttggaacacagagtgtgggagagtggggaagagccagctccagcctgagcaaagctgaagggtagaatgacagtccagtttctgaaaagagatattttaattttagttcagctttattttcctaagacgatatgaagcctacttttttatttttggctaggtctttgttttctagctttgtttccaaaaggatgcttaagaaaacagagtttttttcccctatccatttatctagggtagaaagtcactgccctgtgagaagaattacccttccaatcatgacagcttctattccaacttttcatatacctgactaacctgtaaacatatcccacaaaccacatacacaggctacctattaaaactctcccatatacctaacacatacacatgcacacacatacaaaatatatacatatcacacacttagagaatgacagatttcaggcaatggccaatagtcagtattgagtttttctaaccccagaatctggttgggctttatgatctaaaaaaatgtggtttagaaaagaggataattggtagagctgtagtttgaaaatatcaggtcaaagttgcaaacatacttatgatggaatcatttcatttttagttcctttcccagaaaagctgagagagcacactgttccagctgacttttttttccattaatagccgttctattcaacaaagagctgcccacatgccaggaaagtgctacagtccttctaagcttttaaaaatggggatcaagctacatgcagccagttggaatacttaagatctttatgccaagacacaataacctgacctgcagctgttgtattgcctccatagtatatctagccaaactgtagtctttgacacacaactttttagtcattcactatcaattgcaaagcttcatgctccagccctggctattctagtaccagtcctatacctttaaatgggacttaattcccagttataatcctggccgaattgatttgaaagtcaagtggctgaagcagcttgcatctcctttgtcattcccaatttcctttgggagaagtcaatgaaagagatttacttaagtttttcctccttatctcttgatcattaattattaagacatgggtaaaattcatttgtctcatgtcttttggttgattgaataatatagttactttttgaaagcccatcatttctttgtgataaaaccattttctcaatgtgacagccacatgtaaaatgtgaaactaatgtttcttagtatgtttaaaatcttcacaatcatatatggccctgcaatactccctgaattccttccctccaaaaaaaaactatgagttgcaaaaacactagttacgaattaatcaagaagcaaagagagtatgttaagtggctatgttctttaaaattttacattctaatagatgacttctaggcaaaattttggtatgattaccattaaacaggaaaacataccatgatttactttctataacttgctaatcactgtttcttttatttcaatttttgatattgttgcacaagtttatgactctttggtctttatattcaaaatttattaagtatcaattctttctttcaacaaatatgtactgaacacatgctgtgttagaacaactgtcttgggtagtaaaaagaggggaacactacaaattataatggataatattaatgaagggtggcatgaaataatcaagctttctcaaatcctcttaatatgtgattttatcaagtgacattagaaaaactgacatcagttcttgtctaattatatgtgagctgcaactaaaagatgcttcctttacctaaattatagaactcactggatcgcccttcatctctctccctccatctgaaatgtatgaattaaatcaggactcagctaggactgaatcaaatgaaaaagaaattttcgattaattgcttcttcaatgttagacctatataagtgatgctaaatttacaccagcaaactcctatcagacagtttcaaggaggatttgactcatgcataacccaggaaacatttcaggaaacttttaagacaacagtgtggaacacaatcactcttacttctatttataaaaagcctatcaaaacagcaaaatcctgttgcaaattccaaagacatcactttgcagcaggtggaaaacagagaggttgttagactccatcactttcagctggagttacaaaccatcaaattagcaggtggaaaatttatattctcagaagccaacaggagactgcctttttaaaaggtgtcatgaagccttctatttctccaaacaactcaatatttctctttaaaatggcatctctgttccttattctcttgatgacagtttgcagtgccattatagccagtgtattaaataccaggctttaatgggaagcacctttgtgctttcaaaggcaagacttgtctgtaattttaaattagaactgttggttgtattcttaccacaaccaaaacccaaagtttaaaggcttgattactctatattaggtctaatatgaattttcaccttctgattgcattactttttctgaaatctgctaactagtgctggaataacaaaaatgcctaagccaaaatgctgtagctctgcaccaacagcacagctcatcagatgttttctatagtagtaaagaatttgattgacttaattgaatatcagcaattttaatacccactagaattatggaagtatcagagtggaagtgaggacgcaataaaagcttaataagtggtggtgtcttctaggaattatgaaaaaaaaagctcagcagagctaagccagatcttattacatcataaagactagagttacaaatggcagccccaaacctagaaggggcagttacaatgtggacaccctttcagcccagttggtgctcacatctgctgaccaacattcatatcaattacatttttacagtctgtaagtcatttgatgctttagaaaataaaaacacacacctacagcattctaaagaaactattttgttaaaaaatttaaacacattttatattaaaataagtgatcaatgactttcatgattgtcaaaagtaaaaagtgcagacatttaaaaaagctcttctttcacattttacctaccaaatctagatattcaacgtgagtccttaaaacagtcacttctaaattttattttgactcctttcttggctttttcaaactggaccatgagacccccttcctaaacaatgcagttgttttgttttattctttttttccagaaattcaagctgaaacatttgatatgacctgtgttttacctggtgatcagttctcaggctagtctaagtctgtgctgtcttggcatgccttgggtttcctatcctgagagtggtaatgccagtagaatgatgggaaccaggagagtgaatacgaccagattcaaagcctaaaacaatatgtttcagtttacttttatatgtagattttttaaatattcacatctagcctggaattttagtaaatacagatacttgttgtatccatgggaaatgaggtcatttcaaagatgtaagtcacgttggtgactactttcttttacttgtgataaatatatcactatacagggtaattgcttttataaatttgatcctttgcattggcttataattcaagaaatgtcaacttcactgtgtcactttatgtcatctctcataaaagtttctggcaggactaaagtttcaaaggaatgtgatagaatttattttggataacatttgtattcagcatgctaatgatgtaactcctctctttatcattaccacggtgatagttaagttcattcgttaactcattttagtgacatgtgaggccatttaaatatttttaagataatgtatattgattagaaagggttagaaggagacaaatttatggtagaaattagccttgccattgtctaagttaatttatgtgacctgattgaacagttttagttgtaactttagagtagcttctttgttagaggatctctttcctttctcttttggttttctcccaatatttttatctgtcttgggattatcttaaaaggtatttattaatgagtatttggaagaaaattgacctagaaaatgtctcttttaaatttatctaggtacttgtatcaccagagaccttcatcaagtcctactgccacactggataaggccactacccccgacccttcttgtcagggacatggcttcctaataatggttttgctgttgtctctacataggggacctatggaaaaggagtttgaaatttctacctttgtagtacattgtatccaattttgttttgctcctccttttcatgtggtcaccaagcttttttccttagccattaaaaaagccacccctctttaaaacaaatttaaagatctatatacatttttgcaactttatttaataaaaaagagaagaaaaaataaaatctaaatctcaattaccctaaagtggaaaaacctaagtatctaacctaggaacttgttgcctggtggtggttgttgttgttgttgttttttaatttatttagtgttgatccttgagttatttaatggtatccaaatgatatctgaaagtgattgattttaagatgtaatagttggcaaagtcatttcatttgtgtctcaaacaaataaagcccactgccatgggttaccatctgaaccctgattcattaggcactagtcatgccaaatggggatctcagaatagtttaatcttttcaaagatactcacaatggccaactgtgtgtgaatactggaaagtttgagattcttctatattcttcaaatttatggtcctgagactaggagggatctccagaggtcatatggctcatcgatctaccaccagggaagactgtcacttaggcatgcccaacaggagagatcgccatctattcttaacatctctagggaaggcagtttccttggcaacacaattcagctctcttaggttttctcacaataagaaaatatcttggccagtctttgagggttaggcacctggcaacagttgtggtgatttgggccattgtactaggggattcaagggaagttgggtttccccctacatttggtgattattacattaatatatgatcattccataagtctcctaagaaatcagatttttaaagaaagacacggattcagagacaatggtctgtaacatgaccaacttttgacaaatatggctgtactaggttttcatttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaaaggacttgggtgttatccttcagtctgtgttgaaccattcagatattgggaatggtccttacacaagggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgta

SEQ ID NO: 124071 - DNA, 482 bp, Homo sapiens
  Payload ID: 4362
  Gene Symbol: CSRNP3
  Gene Name: cysteine-serine-rich nuclear protein 3
  ENST ID: ENST00000409664
  CDS Start-End: 67-482
agtgtgttctgacggagccgaagtacagaaaccatatttacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaa

SEQ ID NO: 124072 - DNA, 2545 bp, Homo sapiens
  Payload ID: 4362
  Gene Symbol: CSRNP3
  Gene Name: cysteine-serine-rich nuclear protein 3
  ENST ID: ENST00000409420
  CDS Start-End: 251-2104
tcctgctctcccgtgattcaggtagcctggcagaaccgcagttccacaattccttacccagcattccgtttcagctgctggaggactgcctgagccttatgcaaatgagaccagctcggaggctttgactgcagaagcgagaggagggggcagaagggagttcaaaggtcacagggctggtggaaagctggatcagttgcctgaaaaaaatgtactggggttctctgcagcagtgttttgcagcagttaaatgaagtgtgctttatttctgagagtgaagattttacagcgtgtgtgccgtagtcgttatatagtgcacgcaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaa

SEQ ID NO: 124073 - DNA, 1688 bp, Homo sapiens
  Payload ID: 4362
  Gene Symbol: CSRNP3
  Gene Name: cysteine-serine-rich nuclear protein 3
  ENST ID: ENST00000421875
  CDS Start-End: 377-1688
attggttggctgccgcctgatggatagacgagggaggagtgtactctcttcagtgtgttctgacggagccgaagtacagaaaccatatttacaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccagaaaaaatgaggaaatatcaacagactgaaaatatgttttcagaggcatagaatcttcaggaaaatactggagttcctgagatctcaaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattacc

SEQ ID NO: 124074 - DNA, 2576 bp, Homo sapiens
  Payload ID: 4363
  Gene Symbol: CYSLTR1
  Gene Name: cysteinyl leukotriene receptor 1
  Uniprot ID: Q9Y271
  ENST ID: ENST00000373304
  CDS Start-End: 294-1307
gagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcagcgtgggcttcctctaatattacaccgtaaaaggcattgatcaccataagaaggaacatttgtgaaggtactccagtgccagaaagaggcacaaagcagacattcgtagagaaacatggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacattcagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaataaaaattttacttaatattttacaaatacttaactatttgggcctacaactctatctcatttatgcatccacatgattagatatttatagatattttaagtgctaaaaattcggtccacaactatgaactgaattataaataattttgaccactcaccagaatttggagaatatttttatctttgcactataaaatatgtcttatattaaagttttcctcttcaaataaaagctttacaaacgataaaatatataaaattagtcaataaaaatacatgcaagctaaaagttataaaatataaaactagatataaaattggcaaatagttctgaatcattctaacatattcctttgcatgcatgccatcagatgagaactggagatgactcaggagctacataaaacgtactgtcacccttctttgtagtactgattcgctaggcaaattagggccatttcttccaaaagagaatgtaaaagtgctagaacagactagtattcagctaaagggtcctaaaagcaccatacaatgttcaatatggcaacaggagaaatctggtcaaaagccagtttgtctccagttttcttctgcctttgcctcaggctcccaaaattgaatagtggagttttagctgctcagtgaggttcctgtagagatttctctccatccatgacatataattcttccttaagaagccagacaactggcactcctatatataaatagaagtaattaaaaacttatctgaagaagagaaaaggaaaaggaatctacttttctatatgccaattgctgggatcaaaataaactacaaaggatttatgaagaaaattgtgaatgttcacattacaaattcttttaagaagtgcatacatttatgtatatgtatacaactatatgtaagagattttgctgtatgatatgcattatgggtgaaagttcacgataagttttattattgctttattactttttattggtatgttgacaggaatatcatggatatgtttacagtgacttttatattacagtggacgctttgatcttaaaacagccacaacaactcatctacggctgaaatataatatgcgtggacaagcttttgctgaagtgtagtgtgtcctttaagtttgttttttaaaaagtaacttacctcagaagaaataaataactataaagaaaaaagaaa

SEQ ID NO: 124075 - DNA, 2681 bp, Homo sapiens
  Payload ID: 4363
  Gene Symbol: CYSLTR1
  Gene Name: cysteinyl leukotriene receptor 1
  Uniprot ID: Q9Y271
  ENST ID: ENST00000614798
  CDS Start-End: 415-1428
gtttctattcttccttcctctttgacccttcccctcccccactttgcaccagagaagtcagactccgggagtgctttaacagtttgaaggctaatctgaaagaggaagaagaatctgtatatctgtatatattggctagcaaatgtgccctgctctctcccctcttaaaaatagcagcaacccatctttgcaaagaagcttgcctatagagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcaggcacaaagcagacattcgtagagaaacatggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacattcagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaataaaaattttacttaatattttacaaatacttaactatttgggcctacaactctatctcatttatgcatccacatgattagatatttatagatattttaagtgctaaaaattcggtccacaactatgaactgaattataaataattttgaccactcaccagaatttggagaatatttttatctttgcactataaaatatgtcttatattaaagttttcctcttcaaataaaagctttacaaacgataaaatatataaaattagtcaataaaaatacatgcaagctaaaagttataaaatataaaactagatataaaattggcaaatagttctgaatcattctaacatattcctttgcatgcatgccatcagatgagaactggagatgactcaggagctacataaaacgtactgtcacccttctttgtagtactgattcgctaggcaaattagggccatttcttccaaaagagaatgtaaaagtgctagaacagactagtattcagctaaagggtcctaaaagcaccatacaatgttcaatatggcaacaggagaaatctggtcaaaagccagtttgtctccagttttcttctgcctttgcctcaggctcccaaaattgaatagtggagttttagctgctcagtgaggttcctgtagagatttctctccatccatgacatataattcttccttaagaagccagacaactggcactcctatatataaatagaagtaattaaaaacttatctgaagaagagaaaaggaaaaggaatctacttttctatatgccaattgctgggatcaaaataaactacaaaggatttatgaagaaaattgtgaatgttcacattacaaattcttttaagaagtgcatacatttatgtatatgtatacaactatatgtaagagattttgctgtatgatatgcattatgggtgaaagttcacgataagttttattattgctttattactttttattggtatgttgacaggaatatcatggatatgtttacagtgacttttatattacagtggacgctttgatcttaaaacagccacaacaactcatctacggctgaaatataatatgcgtggacaagcttttgctgaagtgtagtgtgtcctttaagtttgttttttaaaaagtaacttacctcagaagaaataaataact

SEQ ID NO: 124076 - DNA, 4672 bp, Homo sapiens
  Payload ID: 4364
  Gene Symbol: CYSLTR2
  Gene Name: cysteinyl leukotriene receptor 2
  Uniprot ID: Q9NS75
  ENST ID: ENST00000282018
  CDS Start-End: 264-1304
aagttctctaagtttgaagcgtcagcttcaaccaaacaaattaatggctattctacattcaaaaatcaggaaatttaaatttattatgaaatgtaatgcagcatgtagtaaagacttaaccagtgttttaaaactcaactttcaaagaaaagatagtattgctccctgtttcattaaaacctagagagatgtaatcagtaagcaagaaggaaaaagggaaattcacaaagtaactttttgtgtctgtttctttttaacccagcatggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatcagactgggaaaaaatgcaaagcacattggatcctacttttcttcagatattgaaccagatctctggcccatcaggctttctaaattcttcaaaagagccacaacttccccagcttctccagctcccctgtcctcttcaatcccttgagatatagccaactaacgacgctactggaagccccagagcagaaaagaagcacatcctaagattcagggaaagactaactgtgaaaaggaaggctgtcctataacaaagcagcatcaagtcccaagtaaggacagtgagagaaaagggggagaaggattggagcaaaagagaactggcaataagtaggggaaggaagaatttcattttgcattgggagagaggttctaacacactgaaggcaaccctatttctactgtttctctcttgccagggtattaggaaggacaggaaaagtaggaggaggatctggggcattgccctaggaaatgaaagaattgtgtatagaatggaagggggatcatcaaggacatgtatctcaaattttctttgagatgcaggttagttgaccttgctgcagttctccttcccattaattcattgggatggaagccaaaaataaaagaggtgcctctgaggattagggttgagcactcaagggaaagatggagtagagggcaaatagcaaaagttgttgcactcctgaaattctattaacatttccgcagaagatgagtagggagatgctgccttcccttttgagatagtgtagaaaaacactagatagtgtgagaggttcctttctgtccactgaaacaaggctaaggatactaccaactactatcaccatgaccattgtactgacaacaattgaatgcagtctccctgcagggcagattatgccaggcactttacatttgttgatcccatttgacattcacaccaaagctctgagttccattttacagctgaagaaattgaagcttagagaaattaagaagcttgtttaagtttacacagctagtaagagttttaaaaatctctgtgcagaagtgttggctgggtgctctccccaccactacccttgtaaacttccaggaagattggttgaaagtctgaataaaagctgtcctttcctaccaatttcctccccctcctcactctcacaagaaaaccaaaagtttctcttcagagttgttgactcatagtacagtaaagggtggaggtgatatggcattctgaaagtagggagggactaagtcagtcatcatactaaacaaaaatcccagtaccctttccttatttagctaccagaatgatgacagacagactcaaaccctgtcaagacaggaccctggaggatcctcctatggggaaactgcataatctgaaaaaaaggctgacagatacaaatagttgaggatccttcaacacaaaagctgcgtgtctgccctattactcacctgacgatgaagcccacaatgcaacaaatcccttccactcacagcatttggtcaacctgtcagagcctcattcttaattatgaaaagtagtcaatgaacacaatacatttgagggaaaggccgtaacatgaaaggcaccaacaaataaatgtgagagtagatagagaccttttgagtataaaagatcctccaaaataagagattaaaccaagatagaggaaaacacagtagctgggaaacaaggaatccaacgcaggagaaagtgaagagaattcccaggatgttggtgtgtagcaggcttagaaagcaagtcattcatgttggagcaggactcttaaaggactctaggagagatgtctcccagaaaaagaagaaattaattgattcatacacattgagagggatttagatttctcttgcagagattgagataaactagtcgtaaatacatagaaaaataagcaagtaaaaacgcaatacagtttttaagtgctagaggaaaagaaacttttgtattagagaggaaatataaccacagtacactacatggctcagctgtgaataatatttacatagaggataatgtgaatataatagtctcccattatctgtggttttgctttctgcagttcagttacagccagccagtctgaaaatattaaatggaaaattccagaaataattcttaagttttaaaacatgtgctgttttgagtagcatgttgaaatctcgcactatcaccctccacccatgttctgggcagggcaaagtgggatggtgtgagatttctccagtggatccacaatgtatatgctacccacccatgagtcacttagtcatcatccagttgctcagatcaactgttgtggtataacagtgcttgtgttaaagtcactcttattttacttactaatgtccccaaagcataagagtagtgatgctggcaaataagatacaccaaagagaagctgtaaagtgcttcctctaacagaaaatgtgaaagttcttgacttaataaggaaagaaaaaaaacacatgctgaagttgctaagatctacagtaagaacaaatccatctgtaaaattgtgaagaaggcaaaagaaatttgtgctagttttgctgttgcaccacaagctgcaaaaattatttattacaccccacggtgtgtgataaacacttagttaagatgaaaaggtattaaatttgtgggtggaagacatgaacagaaatgtgttccaattgacagcaatcgggtttggtactatttgggtttggtgctattcgtattcagggtcttggaatgcaactcccacagataagggggtgctgctggagtgaaatactgtgatataacctttttttcaggaaatgaagggagaagatgtgtacgtgtgtgggagaggtataagagacctaggttgccatattctatcacagaaaatgcataataactaaatctggaaaatgatgaatagctgtacaaccatattatttagcaataggaggtaaatacaggtagaagcagaagaaagaatgggcaggggttacctctatggagaagctggggtgggaggatagggtggggacttattttacgaactgtgtaattgcctaacttgtgaatatgtatttctgaagtaaaataaaaattaagttaaaattaaattttaaaattcaaa

SEQ ID NO: 124077 - DNA, 1908 bp, Homo sapiens
  Payload ID: 4364
  Gene Symbol: CYSLTR2
  Gene Name: cysteinyl leukotriene receptor 2
  Uniprot ID: Q9NS75
  ENST ID: ENST00000614739
  CDS Start-End: 550-1590
aatgacaaaaaaccagtcattagaggggcagggcaattttaggtttcttctttttagacatagcccctaactggaaattttcacccttcttgagaagggagcttgcactaacatctacaatggcttctaaaaagcacagatgacctgctacacttcctgacttgcttgctattggttggcactgttcataaatataatttgctctttcacttttctttgaaatgagcaacctgaattactcggaggagaaaggcaggagagatagaggcagcagaagccagggcagctgaaagacagagaccttcagtctgaaccaacaacaagcaaagttaaattatggatatccaagggagtctatagaaggtccatgcaagacattttgactacttgtctgaactagatatcccttgaatgtgcacacaaaaagtgaatgggtcatttgataagggaaaactaggttccaagatggctgaataggaagagctccaatctgcagatcccagtgtgagcaacgtggaagacgggtgatttctgcatttccaactgagcatggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatcagactgggaaaaaatgcaaagcacattggatcctacttttcttcagatattgaaccagatctctggcccatcaggct

SEQ ID NO: 124078 - DNA, 727 bp, Homo sapiens
  Payload ID: 4364
  Gene Symbol: CYSLTR2
  Gene Name: cysteinyl leukotriene receptor 2
  ENST ID: ENST00000622559
  CDS Start-End: 684-727
attagaggggcagggcaattttaggtttcttctttttagacatagcccctaactggaaattttcacccttcttgagaagggagcttgcactaacatctacaatggcttctaaaaagcacagatgacctgctacacttcctgacttgcttgctattggttggcactgttcataaatataatttgctctttcacttttctttgaaatgagcaacctgaattactcggaggagaaaggcaggagagatagaggcagcagaagccagggcagctgaaagacagagaccttcagtctgaaccaacaacaagcaaagttaaattatggatatccaagggagtctatagaaggtccatgcaaggtatggagagttcctcaacagagacattttgactacttgtctgaactagatatcccttgaatgtgcacacaaaaagtgaatgggtcatttgataagagcccaagaccaccagaaaccctcctgtaatggaacaagttggctttattactaattgcaacaaggcttttgaaagccttctgtcatcttcctggggatcacctcttcaggtgtacagagacagcatagggaaaactaggttccaagatggctgaataggaagagctccaatctgcagatcccagtgtgagcaacgtggaagacgggtgatttctgcatttccaactgagcatggagagaaaatttatgtccttgcaaccatccatctccgtatc

SEQ ID NO: 124079 - DNA, 334 bp, Homo sapiens
  Payload ID: 4364
  Gene Symbol: CYSLTR2
  Gene Name: cysteinyl leukotriene receptor 2
  ENST ID: ENST00000621321
  CDS Start-End: 291-334
attagaggggcagggcaattttaggtttcttctttttagacatagcccctaactggaaattttcacccttcttgagaagggagcttgcactaacatctacaatggcttctaaaaagcacagatgacctgctacacttcctgacttgcttgctattggttggcactgttcataaatataatttgctctttcacttttctttgaaatgagcaacctgaattactcggaggagaaaggcaggagagatagaggcagcagaagccagggcagctgaaagacagagaccttcagcatggagagaaaatttatgtccttgcaaccatccatctccgtatc

SEQ ID NO: 124080 - DNA, 704 bp, Homo sapiens
  Payload ID: 4364
  Gene Symbol: CYSLTR2
  Gene Name: cysteinyl leukotriene receptor 2
  ENST ID: ENST00000617562
  CDS Start-End: 661-704
attagaggggcagggcaattttaggtttcttctttttagacatagcccctaactggaaattttcacccttcttgagaagggagcttgcactaacatctacaatggcttctaaaaagcacagatgacctgctacacttcctgacttgcttgctattggttggcactgttcataaatataatttgctctttcacttttctttgaaatgagcaacctgaattactcggaggagaaaggcaggagagatagaggcagcagaagccagggcagctgaaagacagagaccttcagtctgaaccaacaacaagcaaagttaaattatggatatccaagggagtctatagaaggtccatgcaagacattttgactacttgtctgaactagatatcccttgaatgtgcacacaaaaagtgaatgggtcatttgataagagcccaagaccaccagaaaccctcctgtaatggaacaagttggctttattactaattgcaacaaggcttttgaaagccttctgtcatcttcctggggatcacctcttcaggtgtacagagacagcatagggaaaactaggttccaagatggctgaataggaagagctccaatctgcagatcccagtgtgagcaacgtggaagacgggtgatttctgcatttccaactgagcatggagagaaaatttatgtccttgcaaccatccatctccgtatc

SEQ ID NO: 124081 - DNA, 2491 bp, Homo sapiens
  Payload ID: 4365
  Gene Symbol: CARS
  Gene Name: cysteinyl-tRNA synthetase
  Uniprot ID: P49589
  ENST ID: ENST00000278224
  CDS Start-End: 52-2232
agattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtga

SEQ ID NO: 124082 - DNA, 2758 bp, Homo sapiens
  Payload ID: 4365
  Gene Symbol: CARS
  Gene Name: cysteinyl-tRNA synthetase
  Uniprot ID: P49589
  ENST ID: ENST00000380525
  CDS Start-End: 71-2566
ccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124083 - DNA, 2685 bp, Homo sapiens
  Payload ID: 4365
  Gene Symbol: CARS
  Gene Name: cysteinyl-tRNA synthetase
  Uniprot ID: P49589
  ENST ID: ENST00000397111
  CDS Start-End: 247-2493
gactactcccagcacggccactgaacgcttggccgcgcgatgctccggagcgcgggtcgccattgggttgaactacagctcccagcatgctccgggccggcgacatccggagcccctggtagttgcctagcgaccgggcgtgtcccggaagacgggcccggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124084 - DNA, 1021 bp, Homo sapiens
  Payload ID: 4365
  Gene Symbol: CARS
  Gene Name: cysteinyl-tRNA synthetase
  ENST ID: ENST00000439280
  CDS Start-End: 63-200
gcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgtaagtgtcacgattgtcttgtgctggctctcttgcgctaagggccctgatttctaaattcctgttttggcaaggccagctcaattaagcggccaagtcaacattgaacttgagttgaggggcataatgggcttttcgttttatgaattgggaacgtttttatggagcgcgtggttttcagaagggaaaatcccaggacattctcatgtcttgcacagg

SEQ ID NO: 124085 - DNA, 2805 bp, Homo sapiens
  Payload ID: 4365
  Gene Symbol: CARS
  Gene Name: cysteinyl-tRNA synthetase
  ENST ID: ENST00000531387
  CDS Start-End: 71-457
ccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124086 - DNA, 2637 bp, Homo sapiens
  Payload ID: 4365
  Gene Symbol: CARS
  Gene Name: cysteinyl-tRNA synthetase
  ENST ID: ENST00000529772
  CDS Start-End: 160-2379
ctgtagccgcagctgcgggtccgggattcccagccatggcagattcctccgggcagcaggcttttcctttgcggtcttgaaggtgcataggcttggtgcctgtccaagagcctgattatttcagaaggatgagtttcatttctgaggtttctggggtagatggagcctacctcagggcctttccgcacagacttgggataccacttggtcggctgctcatcaggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtg

SEQ ID NO: 124087 - DNA, 564 bp, Homo sapiens
  Payload ID: 4365
  Gene Symbol: CARS
  Gene Name: cysteinyl-tRNA synthetase
  ENST ID: ENST00000527330
  CDS Start-End: 50-280
attctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccagctctcgtggggtccccagatgctgagttcccgtgacactcagacctgacaggcctgacgctgggttggctgtgaccgccccccgaccactggatggtcatggctgtagctcctgacgagtagctggctgttggggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggag

SEQ ID NO: 124088 - DNA, 2758 bp, Homo sapiens
  Payload ID: 4365
  Gene Symbol: CARS
  Gene Name: cysteinyl-tRNA synthetase
  Uniprot ID: P49589
  ENST ID: ENST00000612826
  CDS Start-End: 71-2566
ccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcctgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124089 - DNA, 564 bp, Homo sapiens
  Payload ID: 4365
  Gene Symbol: CARS
  Gene Name: cysteinyl-tRNA synthetase
  ENST ID: ENST00000626648
  CDS Start-End: 50-280
attctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccagctctcgtggggtccccagatgctgagttcccatgacactcagacctgacaggcctgacgctgggttggctgtgaccgccccccgaccactggatggtcatggctgtagctcctgacgagtagctggctgttggggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggag

SEQ ID NO: 124090 - DNA, 2491 bp, Homo sapiens
  Payload ID: 4365
  Gene Symbol: CARS
  Gene Name: cysteinyl-tRNA synthetase
  Uniprot ID: P49589
  ENST ID: ENST00000632612
  CDS Start-End: 52-2232
agattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcctgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtga

SEQ ID NO: 124091 - DNA, 2637 bp, Homo sapiens
  Payload ID: 4365
  Gene Symbol: CARS
  Gene Name: cysteinyl-tRNA synthetase
  ENST ID: ENST00000633563
  CDS Start-End: 160-2379
ctgtagccgcagctgcgggtccgggattcccagccatggcagattcctccgggcagcaggcttttcctttgcagtcttgaaggtgcataggcttggtgcctgtccaagagcttgattatttcagaaggatgagtttcatttctgaggtttctggggtagatggagcctacctcagggcctttccgcacagacttgggataccacttggtcggctgctcatcaggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcctgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtg

SEQ ID NO: 124092 - DNA, 1021 bp, Homo sapiens; identical to SEQ ID NO: 124084
  Payload ID: 4365
  Gene Symbol: CARS
  Gene Name: cysteinyl-tRNA synthetase
  ENST ID: ENST00000632806
  CDS Start-End: 63-200

SEQ ID NO: 124093 - DNA, 2685 bp, Homo sapiens
  Payload ID: 4365
  Gene Symbol: CARS
  Gene Name: cysteinyl-tRNA synthetase
  Uniprot ID: P49589
  ENST ID: ENST00000633248
  CDS Start-End: 247-2493
gactactcccagcacggccactgaacgcttggccgcgcgatgctccggagcgcgggtcgccattgggttgaactacagctcccagcatgctccgggccggcgacatccggagcccctggtagttgcctagcgaccgggcgtgtcccggaagacgggcccggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcctgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124094 - DNA, 2805 bp, Homo sapiens
  Payload ID: 4365
  Gene Symbol: CARS
  Gene Name: cysteinyl-tRNA synthetase
  ENST ID: ENST00000634057
  CDS Start-End: 71-457
ccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcctgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 124095 - DNA, 1879 bp, Homo sapiens
  Payload ID: 4366
  Gene Symbol: CARS2
  Gene Name: cysteinyl-tRNA synthetase 2, mitochondrial (putative)
  Uniprot ID: Q9HA77
  ENST ID: ENST00000257347
  CDS Start-End: 65-1759
agcgaccggcagcgtacccggcgtggctcccgtctccgcccagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaa

SEQ ID NO: 124096 - DNA, 720 bp, Homo sapiens
  Payload ID: 4366
  Gene Symbol: CARS2
  Gene Name: cysteinyl-tRNA synthetase 2, mitochondrial (putative)
  ENST ID: ENST00000537394
  CDS Start-End: 41-505
ggctcccgtctccgcccagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagagagtcttgctctgtcgcccaggctggagtgcagtggcaccttcttggctgactgcaacctccgcctcctgagttcaagtgattctcctgcctcagccacctgagtctctgggattacagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattc

SEQ ID NO: 124097 - DNA, 844 bp, Homo sapiens
  Payload ID: 4366
  Gene Symbol: CARS2
  Gene Name: cysteinyl-tRNA synthetase 2, mitochondrial (putative)
  ENST ID: ENST00000487253
  CDS Start-End: 1-530
ggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacatacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatcca

SEQ ID NO: 124098 - DNA, 795 bp, Homo sapiens
  Payload ID: 4366
  Gene Symbol: CARS2
  Gene Name: cysteinyl-tRNA synthetase 2, mitochondrial (putative)
  ENST ID: ENST00000539269
  CDS Start-End: 1-359
tgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgaggcatgagtcaaaggaatggtgtgaggtccttgaggaacattttcactgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctag

SEQ ID NO: 124099 - DNA, 466 bp, Homo sapiens
  Payload ID: 4366
  Gene Symbol: CARS2
  Gene Name: cysteinyl-tRNA synthetase 2, mitochondrial (putative)
  ENST ID: ENST00000537743
  CDS Start-End: 1-277
ctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggctcagagctggctggatccttaaccaacctgaaaaatggcatcatgctatgctgctgacacatggaatgtgaattttcgtgtgaatggaaaacaggcacacccacggagggctctggctgacatagtttgaactcctcctttgtcttctggcctgtctttaaagccagatttaatttaattgcaaaataaatggagaagaatagtatccaga

SEQ ID NO: 124100 - DNA, 572 bp, Homo sapiens
  Payload ID: 4366
  Gene Symbol: CARS2
  Gene Name: cysteinyl-tRNA synthetase 2, mitochondrial (putative)
  ENST ID: ENST00000542709
  CDS Start-End: 30-572
gggctcggggagggcgtttaggaagctgcatggagggcgccgttctagaagctgggggtgcgcggtgcttttgcaggtttgggtgtgaattgagcaagtatgaaaaccccggctattcatcccccagaagtgattactttaaaaattatatgatcattataactcagaatcgaatgtcctttcttgcaaatatgttccacacgatggattttaactttgtttccaggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaa

SEQ ID NO: 124101 - DNA, 668 bp, Homo sapiens
  Payload ID: 4366
  Gene Symbol: CARS2
  Gene Name: cysteinyl-tRNA synthetase 2, mitochondrial (putative)
  ENST ID: ENST00000620794
  CDS Start-End: 1-271
gatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagttggcaaactctcgtgcgcagaaccagagatgagtccatctcagcaacagaatgtcgccagctctgcacacacgtttatgttcaaagactctcagaatgtgcagaagtcacaggcacagtaagagaacattttttcctgacccatttgagggcaagttggcgacctgagcccccttgcctggcacatgttttgtacggacaggacgggctccccgacaggcacgagtcacctgcaccttcccagcgaggctcaccctggctgtgcagtgaaggtggacgctgccaggcttctccacattccttctcttccgttgtaactcaagagcatttttgcaaagagacttggatcctatgaaaatgtcctcttccttatcaggctcacctgaaactcgtttattctatcaatacagatttgaggtttcctgcctta

SEQ ID NO: 124102 - DNA, 6132 bp, Homo sapiens
  Payload ID: 4367
  Gene Symbol: CFTR
  Gene Name: cystic fibrosis transmembrane conductance regulator (ATP-binding cassette sub-family C, member 7)
  Uniprot ID: P13569
  ENST ID: ENST00000003084
  CDS Start-End: 133-4575
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaa

SEQ ID NO: 124103 - DNA, 4316 bp, Homo sapiens
  Payload ID: 4367
  Gene Symbol: CFTR
  Gene Name: cystic fibrosis transmembrane conductance regulator (ATP-binding cassette sub-family C, member 7)
  ENST ID: ENST00000426809
  CDS Start-End: 1-4316
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaaga

SEQ ID NO: 124104 - DNA, 575 bp, Homo sapiens
  Payload ID: 4367
  Gene Symbol: CFTR
  Gene Name: cystic fibrosis transmembrane conductance regulator (ATP-binding cassette sub-family C, member 7)
  ENST ID: ENST00000446805
  CDS Start-End: 466-575
aaagcttggttcttttctccgacacgcaaaggaagcgctaaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcgctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctc

SEQ ID NO: 124105 - DNA, 682 bp, Homo sapiens
  Payload ID: 4367
  Gene Symbol: CFTR
  Gene Name: cystic fibrosis transmembrane conductance regulator (ATP-binding cassette sub-family C, member 7)
  ENST ID: ENST00000468795
  CDS Start-End: 1-572
taaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttatta

SEQ ID NO: 124106 - DNA, 559 bp, Homo sapiens
  Payload ID: 4367
  Gene Symbol: CFTR
  Gene Name: cystic fibrosis transmembrane conductance regulator (ATP-binding cassette sub-family C, member 7)
  ENST ID: ENST00000600166
  CDS Start-End: 1-470
aagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttgataatgatggttgcagggcccctcttcaatggaggcattgccagccttctggccatgaaggagaaagtgatttcaactaacccaggaaactcttacctctaaatggagatacttcctgataacagaagaaactgggcatctaacccagaaataccagctgagtaggagaagagaaaaggcatcagccagtc

SEQ ID NO: 124107 - DNA, 2738 bp, Homo sapiens
  Payload ID: 4368
  Gene Symbol: CYS1
  Gene Name: cystin 1
  Uniprot ID: Q717R9
  ENST ID: ENST00000381813
  CDS Start-End: 189-665
gctcgcacccccgtcctccggccgcgacccccgcccgggaaccctagcccctggccgcggtcgcttcccggacctcgccccgcgcctccccctgcagcccgccccggccgcaccccctagcgtccccgcccccggccgcgccccctcatgggggccccctcggcggtccgggaggcggcgggcgcgccatgggcagcggcagcagccggagcagccggactctgaggcggcggcgcagccccgagagcctccccgcggggcccggagcggcagccctggagggcgggacccgccggcgggtgccggtggcggcggccgaggtcccgggggcagccgcggaggaggcgcccggccgcgaccccagccccgtggcgccccccgacggcagggacgagacgctgcgcctgctggacgagctgctggccgagtcggcggcctggggccccccggagcccgccccgcgccgcccagcccggctccgacccaccgcggtcgcggggagcgcggtgtgcgcagagcagagcacagagggccacccggggagcggcaatgtctctgaagccccaggcagcggtcgcaagaagcccgagaggccggcagccatctcctacgaccactcggaagaggggctgatggcgagcatcgagcgggagtactgccgctgaggacagcatgctccacccccgccaggcctcggaggcacctgctggctggggcaccctctgcttgcacagagctctagcaggagctgaaccacctccaaaacgcagtcactcccggatattcaaagctgccctttcaaatccactttcagaccgcgctgacctgggccagccactggcggtcatggttgctggtgggggcgattagctgtgtagacccacaggtgcgtgggcctgggccgccggcgcctcctccccaacgcggggagcctgcccagttcttctggagcctgaaatgcgtgcccctcttggttgcccgctctccacagtggggagggctcacgaggactaggtgacacaagcgagcccctcctggcatccgcgccacaacacttccggaaggttctgctgtggaaggtgcacccgcgctgctccctcagtctcgggcccatctctccaggggtggccgggtcagcttagtgcttctcaactttaactccctaatgagcagcctgggggtgctgttgacttgcagggcctgaggttctgtacgtctaaccagctcccagcccaggcccgagctccgaagccccaactgcactttgaggagcgagaaccccagctctgatctgccttgcagtgggaggtagagctcgtcactgcctctctgggcctcagtttccctctctggaaaatcagctctggcagctcttggaggccctccccagctctgacaatctggaactgctgccactgctggtcccctgccccaggcacagcagtgccttccctgcggggagccagcgcccaggtccaaccgggagagggtctgcctgatactggctttccagttctccctctcacaggcagcctggccagtgcctgcggggcttttaaattctcttcctgcctgggtggaaggtgggaaaccacagcagtgaggcaggaagagccttggaatgttcctggttgacagatgggaaaactgacctgcccaggacgccctgggaacagggggcggagctccggctagaggggactcctgtgtgggcgggcaggtctggagcctgggcccaggtgtggcctgctgggggacagctccgggggagagctgtggggagaacagcggtctagggaggcaggaggcaggcggcaggctcctccccagcagcctgcagggcatcaggacagagggggaaggaggagacagaagggaaagaaggagatagagggggaaggaggaaacagcgcggcttctgctgaagccagtacaagcctggttatctggcttgacccgcccacacggaggcctccccagcgttttctttttcccgagaagagctccagctcgcaggtccttagaacacagcagagcaggagcatctcaggaaccaacggccagctccttggcgctgtccccagccccacaggcctgctgcggccatccgcaaacgggcatttccttgaacttttgagagtgcctttgaccagctgttcgcagctgggaaactccaacttttgaagtcagagcttggagcggcccccgcaagggcgtggctcaaaccctccccagagctgggagccattgcttatgcaagcccgtttcttttgatgtaaagatggaagtcgttactatattttaataatgcaaatacatcttttaaaataagttaacatttcttaccaccagatggatcaggctttgaatttaaacatgtaaatgtttgtaattttatgtcattttgttaaaatgggacgctttcaattggtttccaagaaagatgatacctctgcattttctggtggaaaaggtgtaatacccttaatgagatcaaagtgttaggggaaaaaaattccaaaagtagttacaagctatatcaatgtcaaagtaaatgcacttcatcaaagctaagaagtcacaggaattgttctcaggtttttaaaaaaatttttcctgaattcaggaagtgtcttctgaatagcagctagccaaataaagcggtgtgtgtgtactgcagctgtaggtgaacttaaaaataataataaaaagaacaaataaagcagtgtgtaccagcc

SEQ ID NO: 124108 - DNA, 2866 bp, Homo sapiens
  Payload ID: 4369
  Gene Symbol: CTNS
  Gene Name: cystinosin, lysosomal cystine transporter
  Uniprot ID: O60931
  ENST ID: ENST00000046640
  CDS Start-End: 594-1697
gatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgaccacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagattagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttc

SEQ ID NO: 124109 - DNA, 2470 bp, Homo sapiens
  Payload ID: 4369
  Gene Symbol: CTNS
  Gene Name: cystinosin, lysosomal cystine transporter
  Uniprot ID: O60931
  ENST ID: ENST00000381870
  CDS Start-End: 460-1662
aatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgaccacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagattagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttctgca

SEQ ID NO: 124110 - DNA, 803 bp, Homo sapiens
  Payload ID: 4369
  Gene Symbol: CTNS
  Gene Name: cystinosin, lysosomal cystine transporter
  ENST ID: ENST00000399306
  CDS Start-End: 233-601
cagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaactggtggaagcaggaggagaagaatgcagggatgagatcagtagccatgaggcacatcaagatgggctgcaaatcagctctgagccccctaggaagcaaacaggagtgaaacacgatcagtctccagcatgtgggaacctgtgatctgaaaaatatagcatcgctggctgcagagatgtgcacctgtaatcccagctacttgggaggctgaggcaggagaatcacttgagcccaggaactcaaggctgcagtgagccatgactgtaccactgccctccagcctgagtgttggagcaagactctgtctctaaaaaattaaaaataaaaataaaatgtttaaaaataa

SEQ ID NO: 124111 - DNA, 617 bp, Homo sapiens
  Payload ID: 4369
  Gene Symbol: CTNS
  Gene Name: cystinosin, lysosomal cystine transporter
  ENST ID: ENST00000452111
  CDS Start-End: 393-617
ctctcccaaagtctagccgggcaggggaacgcggtgcattcctgaccggcacctggcgaggctcatgcgtcccgtgagggcggttcctcgagcctgggggcgctcaggtgagagcggacgcggcctcccctgtttcccaggcggaccccttgaggcacagcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaa

SEQ ID NO: 124112 - DNA, 548 bp, Homo sapiens
  Payload ID: 4369
  Gene Symbol: CTNS
  Gene Name: cystinosin, lysosomal cystine transporter
  ENST ID: ENST00000576979
  CDS Start-End: 61-548
aacattcccctgaacttctctcttgctgtttttcttcctagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgt

SEQ ID NO: 124113 - DNA, 581 bp, Homo sapiens
  Payload ID: 4369
  Gene Symbol: CTNS
  Gene Name: cystinosin, lysosomal cystine transporter
  ENST ID: ENST00000574218
  CDS Start-End: 497-581
attcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagaggttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtat

SEQ ID NO: 124114 - DNA, 590 bp, Homo sapiens
  Payload ID: 4369
  Gene Symbol: CTNS
  Gene Name: cystinosin, lysosomal cystine transporter
  ENST ID: ENST00000467663
  CDS Start-End: 304-465
gtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagc

SEQ ID NO: 124115 - DNA, 565 bp, Homo sapiens
  Payload ID: 4369
  Gene Symbol: CTNS
  Gene Name: cystinosin, lysosomal cystine transporter
  ENST ID: ENST00000574776
  CDS Start-End: 506-565
cccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctg

SEQ ID NO: 124116 - DNA, 3386 bp, Homo sapiens
  Payload ID: 4370
  Gene Symbol: CDADC1
  Gene Name: cytidine and dCMP deaminase domain containing 1
  Uniprot ID: Q9BWV3
  ENST ID: ENST00000251108
  CDS Start-End: 114-1658
agtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccagtgtgccgaactttaaacacttcggattttaccgtagcaatccagaacagattaatgaaattcacaatcaaagtttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggagcttgaaggtgttagcaaatttacgtggcagctgaatccatcaggagcttatggtcttgaacaaaatgagcctgaaaggagagaaaatggtgtgttgagacctgtcccacagaaggaagagcagcaccaggacaagaagctgcgcctcggaatccactaagaaggcctgtctacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttaattctgtggtcctgtttatcacagactttgggtagcaataggaagagagtgttattctgagacagtgtcgctgcttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcagaaaattattccaaaaatgaaggtacattttctgttctctcctaggttagagaggggtggcctggggtgcttcatgagaaatgtcttcctggatctgcggtggtcaggtttgcctctgcttttgttccctgcctttccgccacatcacacggcctcactgggcttcctaccagtttctcagaattacacgcacgaccatccaaacattggctccatgccagggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattcttatcagtataaaaacactgagattgcttacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggttta

SEQ ID NO: 124117 - DNA, 290 bp, Homo sapiens
  Payload ID: 4370
  Gene Symbol: CDADC1
  Gene Name: cytidine and dCMP deaminase domain containing 1
  ENST ID: ENST00000429346
  CDS Start-End: 1-290
ctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggattactggaagcagctaagatgcctagatgaaaggtttaccatcact

SEQ ID NO: 124118 - DNA, 688 bp, Homo sapiens
  Payload ID: 4370
  Gene Symbol: CDADC1
  Gene Name: cytidine and dCMP deaminase domain containing 1
  ENST ID: ENST00000496061
  CDS Start-End: 98-559
acagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatggattactggaagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatc

SEQ ID NO: 124119 - DNA, 644 bp, Homo sapiens
  Payload ID: 4370
  Gene Symbol: CDADC1
  Gene Name: cytidine and dCMP deaminase domain containing 1
  ENST ID: ENST00000484126
  CDS Start-End: 62-370
gggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacagaaaaccatgttctgcttgtttgaaaatgattgtaaatggattactggaagcagctaagatgcctagatgaaaggtttaccatcactgctggttaggaaatggattatgagaactcgaacagagggaaggtgaaatgcaaccggaggaaacactctgatatgagctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatgg

SEQ ID NO: 124120 - DNA, 963 bp, Homo sapiens
  Payload ID: 4371
  Gene Symbol: CDA
  Gene Name: cytidine deaminase
  Uniprot ID: P32320
  ENST ID: ENST00000375071
  CDS Start-End: 183-623
gtccaaaccatgggaggctcctctcctagaccctgcatcctgaaagctgcgtacctgagagcctgcggtctggctgcagggacacacccaaggggaggagctgcaatcgtgtctggggccccagcccaggctggccggagctcctgtttcccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 124121 - DNA, 1212 bp, Homo sapiens
  Payload ID: 4372
  Gene Symbol: CMPK1
  Gene Name: cytidine monophosphate (UMP-CMP) kinase 1, cytosolic
  ENST ID: ENST00000371871
  CDS Start-End: 138-647
gacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttg

SEQ ID NO: 124122 - DNA, 2930 bp, Homo sapiens
  Payload ID: 4372
  Gene Symbol: CMPK1
  Gene Name: cytidine monophosphate (UMP-CMP) kinase 1, cytosolic
  Uniprot ID: P30085
  ENST ID: ENST00000371873
  CDS Start-End: 150-836
gacagggccgcggacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 124123 - DNA, 950 bp, Homo sapiens
  Payload ID: 4372
  Gene Symbol: CMPK1
  Gene Name: cytidine monophosphate (UMP-CMP) kinase 1, cytosolic
  Uniprot ID: P30085
  ENST ID: ENST00000450808
  CDS Start-End: 33-572
agctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgaggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgc

SEQ ID NO: 124124 - DNA, 816 bp, Homo sapiens
  Payload ID: 4372
  Gene Symbol: CMPK1
  Gene Name: cytidine monophosphate (UMP-CMP) kinase 1, cytosolic
  ENST ID: ENST00000471289
  CDS Start-End: 68-244
tccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagggatgacatcttgctatggtgcataggctgatctcaaactcctggcctcgagcaaccctctcgtcttgaccttccaaagtgctgagattacaggcatgagccacagtgcgtagtccctgtttttagaagtttgttcttcaagagattcttctagttgtaacatctaataatgatattttgctgtggctgttagtatagtatagtatgtgtagatgtcatttttggtagcatacatattatttctgttttataaataaacagatctaagaaagattaaacaaattacccactgtcacactgggttgtgacagagttataaaactttagttttagttataaaaccttaagcactctagttcagtgttctgagtgtgtgatttcatgtaaggttcaggttcttgtgatctttgctgagttctttgtgtttctccaaatttatttccccattagtttgataattttgcaaatgctcaaatgttatgtttgcttaatattattatttaggattctgtctcctttgtacatttttctggtgttgattcttaaattcaaataaattctagttcctaaagagcacc

SEQ ID NO: 124125 - DNA, 2884 bp, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENST ID: ENST00000256722
  CDS Start-End: 1-1350
atggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctatataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaatcta

SEQ ID NO: 124126 - DNA, 2042 bp, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENST ID: ENST00000404168
  CDS Start-End: 17-1246
cgtcgctgaggcgcccatggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaagtaggtgtcccagtgcaatgcaatgtgagcggcaggcattcctgaagggagatgaaccactggcactggctttaggattgtgaggaagtgatattgtttccagttttcaaacacaagagacaacatcctctaagttacttcagccccttccaatgggcttgtcaccacagggctgcagcattgttatcttaaagcaaaggtcatcggactagggatcagaccctgccactgatcctggctgtgctaggagcagctgcacctgggtaagacagtaagtgtctctgtgcctcagtttccccagtcatagtataatcacacagagcactagataacgagctcatagtaacatctacctattagatgcttcccgtgtgtcaggcattttactgatgttatgtcatccttgtgaggaaaacattagccgtattttacagtttacaactttaaggctcaaaggattaagtgatttgtctaaatgtacataactattcactagtaaaaccgggattaaaatctttctgattttgcagccagtgtttttgttttaattagaaagttataaacacgactgcagaagagagtctggccaggcctcctgcctcatgactgagtatgaatcagttctacaccactgcctttaaaaactgaagcagaaatattttctctaactgaacaatgatagccctgttatcataacatagtaatgttataaataatggtagctgctgtgggtaaagatattatgttaagcaatttacttgtattaattccattaaacttcagtgaacatttgcaaggaa

SEQ ID NO: 124127 - DNA, 1224 bp, Homo sapiens
  Payload ID: 4373
  Gene Symbol: CMPK2
  Gene Name: cytidine monophosphate (UMP-CMP) kinase 2, mitochondrial
  Uniprot ID: Q5EBM0
  ENST ID: ENST00000458098
  CDS Start-End: 124-1224
aacgcttcgctttcgtttcccgctggcgcctggctccctccgggtttcgtttcccgccggcgcctggctcccgccaggtttcgtttccgaggcggggccgagggcggcgtcgctgaggcgcccatggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtcccagctgggaggaaccttataccatccttctctccacctgctcggcagtgaagtttgtgggactggaatcttggattcatcacactcgagtcaaggcctggaatga

SEQ ID NO: 124128 - DNA, 1787 bp, Homo sapiens
  Payload ID: 4374
  Gene Symbol: CMAS
  Gene Name: cytidine monophosphate N-acetylneuraminic acid synthetase
  Uniprot ID: Q8NFW8
  ENST ID: ENST00000229329
  CDS Start-End: 131-1435
gggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaa

SEQ ID NO: 124129 - DNA, 854 bp, Homo sapiens
  Payload ID: 4374
  Gene Symbol: CMAS
  Gene Name: cytidine monophosphate N-acetylneuraminic acid synthetase
  ENST ID: ENST00000535610
  CDS Start-End: 18-284
gaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttg

SEQ ID NO: 124130 - DNA, 538 bp, Homo sapiens
  Payload ID: 4374
  Gene Symbol: CMAS
  Gene Name: cytidine monophosphate N-acetylneuraminic acid synthetase
  ENST ID: ENST00000538498
  CDS Start-End: 248-538
ggctgttaatttcttttgatatctgaacagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctatt

SEQ ID NO: 124131 - DNA, 1575 bp, Homo sapiens
  Payload ID: 4374
  Gene Symbol: CMAS
  Gene Name: cytidine monophosphate N-acetylneuraminic acid synthetase
  Uniprot ID: Q8NFW8
  ENST ID: ENST00000534981
  CDS Start-End: 80-871
gatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaacttgatgaaaa

SEQ ID NO: 124132 - DNA, 4365 bp, Homo sapiens
  Payload ID: 4375
  Gene Symbol: CYBRD1
  Gene Name: cytochrome b reductase 1
  Uniprot ID: Q53TN4
  ENST ID: ENST00000321348
  CDS Start-End: 199-1059
ccatttctgagttggggccagctccccacccccaagaggccccacattccgggccagcagcccagaaagtccctccccgcaggcggagacagccccaagaagtcgacgccccggtcccgccgcccggccactacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtttgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatatgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaaatgacaaagaaggcaattgcactttttaagggatatcgacaagcagtttctgttttctaaaggacaaaatacagagtgtgtgtcatttttaattagattctttcccctgctgagttggaaattccagtgcagcactgattgaccacagttgccaatctaaaagcacaaagacagaagtaaagctttatgctaattttatttcaatatgatagaaaatttatcttggtatgtccttttttagataactccagcaggaaactgtaactgctatgtctttaggaaaatgtagaagaaagaacattattgttctttaattcctacaaggtactcgaaaaccttaagtgaaaaagatttctatctttttatcttagcgcatttatggaaaaaatattaactatcctgaatattttataattttgtaggaaaaatatgcatctattttttcttgacttcttttatatagtaataaaagttattttggaagctc

SEQ ID NO: 124133 - DNA, 3540 bp, Homo sapiens
  Payload ID: 4375
  Gene Symbol: CYBRD1
  Gene Name: cytochrome b reductase 1
  Uniprot ID: Q53TN4
  ENST ID: ENST00000375252
  CDS Start-End: 70-543
actacccagagggctgccgccgcctctccaagttcttgtggcccccgcggtgcggagtatggggcgctgatggccatggagggctactggcgcttcctggcgctgctggggtcggcactgctcgtcggcttcctgtcggtgatcttcgccctcgtctgggtcctccactaccgagaggggcttggctgggatgggagcgcactagagtttaactggcacccagtgctcatggtcaccggcttcgtcttcatccagggcatcgcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctacaaacctcagagagcacttttccccaagttcttgtttttatttttgaaagtactcacacagcacttactatgctccaaacactcctctaagcactttacacatattagctcattcagtccccagacagacgggatgaagtaggtattgttactgttcccattttacaggtgagagatttgaagcctggggaggctagtaactcaccccaaggtcacacggctcatacatggtgggactgagactcagatgcaggcagtctggcacctcagtctggattctaaccatttcactaagctatttttgtcttgtactactttgacccacccctgaataaacctcaattgctggagtggggtgtagttattaaagggatgctttttaccttttgctgtttgctgtggcagattccccagataaccaaggaaaaggggccacccatacctggaaataggccatagggcccctactactgccaacaagccatggcctaccttgacacttgtttgatcttaaaattgtgtcttggtaacaaaagatttggacaggcatatctgtagctttcaagttaattaattgcaatatttttttcttcaggattttagctgctgaacaactttcagtttggagctaaaagagacctgtctcatggtctgcccttccctggggcaatagctagggtctttcctgatttttatggaattttaggggatattttgagctttgggttctcagtagtgaattgagacttggaggtgacttttcatgtttggagtatcatctctgtctgggatctgggctgacaaattaaaacctagagtagtgcttatgctgaaatgatacttttcattttttggttgatttttttgccttcccttcaattttaaactgaagcattttaatatgggtagaaactctacaccaaatacactaaacattttggtgcttagtggatttctttttaggtaactggtacttacttccaaagactgaatacaagccacactccatcatatcccttaaacttcatgaaaaaccattcaagatccccttgctgcaacactgttctcttcttctctactaaattctatttccaaaattggtaatagagccagaaggatccccagtacccagccctctgcctggcacaaagtggtagcacaattaaattcagtatgggtggagcatggtacagtcttggtgccatagaaggagtagttgcatagtcacacatcatttgataagttggatgttccattacatagaggaacacaaaattccagggtttttggaggaagggattagatagtgactaagccgccagaattgaggtggccattcctttttgtataggctaagaaacaggttatcagtgaaaagttaattatggctttggcactagaatagcactgttgcaaagtatttaagcaccccccatctcagccctttattttatctttcatgtgggctaatgtgaggataatcttacagatattataggaatttcttttctatctttatgaaaacaacgtatataaaatatatctagaaaacctttgtttgagactcttatttaatgggcttttgattctaatgataattgtacctttatctttcaaaagctgatatttcctacctaagcatctcccgagaaaaatatctcattaaaaagcccataaataataggggagaagaaagccttaggtatcaattccaaaacagtgattgaaatttcccaaaataattatggcttctgtcatctccagagataatctggcttggtttaccccataatctaatttcagaaaagaaagctttattttaacactcatctgaatcaacattaaagccttttctctcaaagcgtttattgagaaactcaaatgaatatactttttgaattactgtcatcaaaagtgtacggcttcctgtgctgcttgtgtcaaatggaacctgccctctaaagcactttctttcctttacttgcgtggtttcatgtaagctgtgctgtttagaaacaacatctcagactttacaaagaa

SEQ ID NO: 124134 - DNA, 1493 bp, Homo sapiens
  Payload ID: 4375
  Gene Symbol: CYBRD1
  Gene Name: cytochrome b reductase 1
  Uniprot ID: Q53TN4
  ENST ID: ENST00000409484
  CDS Start-End: 27-713
gttactgaagccctctgcgagcttggatgctggacgagggagaggccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccctcattttttggatagtcaccagaccgcaatggaaacgtcctaaggagccaaattctaccattcttcatccaaatggaggcactgaacagggagcaagaggttccatgccagcctactctggcaacaacatggacaaatcagattcagagttaaacagtgaagtagcagcaaggaaaagaaacttagctctggatgaggctgggcagagatctaccatgtaaaatgttgtagagatagagccatataacgtcacgtttcaaaactagctctacagttttgcttctcctattagccatatgataattgggctatgtagtatcaatatttactttaatcacaaaggatggtttcttgaaataatttgtattgattgaggcctatgaactgacctgaattggaaaggatgtgattaatataaataatagcagatataaattgtggttatgttacctttatcttgttgaggaccacaacattagcacggtgccttgtgcagaatagatactcaatatgtgaatatgtgtctactagtagttaattggataaactggcagcatccctggcctgttgtcatgcagtcatttcctgttaattctgggagacaatgatttcacaactagcgggaagcagtcctaaaagtttaaaatccgataaggaatatctgggacagggtttagatcatgactctacacagataccatgatgagagtatattaaagaaatttaggaaagcacctggttcctttctccccatgcctgccttctgctccctccccagctggtttgggctcaaattgtccctggagactagggtttatgttagggtattgatagattagagcaggtggttgaagagatcttctctggtcagacttggaagaatttccaaaactgaagttagccccaagacttccctagggttgatgtactttatgatccagatgctaaacttcttagaatgaaaatatgcttcaacacttaagtagcatacactgccctac

SEQ ID NO: 124135 - DNA, 682 bp, Homo sapiens
  Payload ID: 4375
  Gene Symbol: CYBRD1
  Gene Name: cytochrome b reductase 1
  ENST ID: ENST00000445146
  CDS Start-End: 159-682
agaaacttgagcccgggcgcgatgccggagcgccgcgcagtcgggccgctgcagcccacgcgccccggaaagtcgcccctgtggaccgagcctgcgcgatcgggggcgcggaaacactttcgcctcagccttttgctgaacttgcttccaggctgcagatgaggaggggaaggcagcggggaaaagattgccggagcgagaatttgcccgtatttgtaacatcctcggccctggccatcatcgtctacagactgccgtggacctggaaatgcagcaagctcctgatgaaatccatccatgcagggttaaatgcagttgctgccattcttgcaattatctctgtggtggccgtgtttgagaaccacaatgttaacaatatagccaatatgtacagtctgcacagctgggttggactgatagctgtcatatgctatttgttacagcttctttcaggtttttcagtctttctgcttccatgggctccgctttctctccgagcatttctcatgcccatacatgtttattctggaattgtcatctttggaacagtgattgcaacagcacttatgggattgacagagaaactgattttttccctgagagatcctgcatacagtacattcccgccagaaggtgttttcgtaaatacgcttggccttctgatcctggtgttcggggccct

SEQ ID NO: 124136 - DNA, 797 bp, Homo sapiens
  Payload ID: 4376
  Gene Symbol: CYBA
  Gene Name: cytochrome b-245, alpha polypeptide
  Uniprot ID: P13498
  ENST ID: ENST00000261623
  CDS Start-End: 140-727
gcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggtggcggcggggggacccccgggaggtccccaggtcaaccccatcccggtgaccgacgaggtcgtgtgacctcgccccggacctgccctcccgccaggtgcacccacctgcaataaatgcagcgaagccgggagcgcgt

SEQ ID NO: 124137 - DNA, 1085 bp, Homo sapiens
  Payload ID: 4376
  Gene Symbol: CYBA
  Gene Name: cytochrome b-245, alpha polypeptide
  ENST ID: ENST00000567174
  CDS Start-End: 29-661
gcagtgtcccagccgggttcgtgtcgccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactgagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctcctcagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaa

SEQ ID NO: 124138 - DNA, 439 bp, Homo sapiens
  Payload ID: 4376
  Gene Symbol: CYBA
  Gene Name: cytochrome b-245, alpha polypeptide
  ENST ID: ENST00000568278
  CDS Start-End: 3-439
ccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctggcctgtgtctgctgtctagtgtgcaggatttgtaaggatccactccaaatccgaggagctccgatccgtcgccagggtctggggctctcggtgcccgccggcttcctgctggccaccatccttgggaccgcctgcctggccattgcgag

SEQ ID NO: 124139 - DNA, 221 bp, Homo sapiens
  Payload ID: 4376
  Gene Symbol: CYBA
  Gene Name: cytochrome b-245, alpha polypeptide
  ENST ID: ENST00000565588
  CDS Start-End: 1-221
atgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactgtgccccgcaggcggctgtgcgtggcgagcagtggacgcccatcgagcccaagccccgggagcggccgc

SEQ ID NO: 124140 - DNA, 1415 bp, Homo sapiens
  Payload ID: 4376
  Gene Symbol: CYBA
  Gene Name: cytochrome b-245, alpha polypeptide
  ENST ID: ENST00000569359
  CDS Start-End: 18-404
gccgggttcgtgtcgccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgcccgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcac

SEQ ID NO: 124141 - DNA, 405 bp, Homo sapiens
  Payload ID: 4376
  Gene Symbol: CYBA
  Gene Name: cytochrome b-245, alpha polypeptide
  ENST ID: ENST00000566229
  CDS Start-End: 16-405
ggactccatttggaaatggaccctctcgggaccagggccagggagtgtctggcccagcacggtcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccat

SEQ ID NO: 124142 - DNA, 4324 bp, Homo sapiens
  Payload ID: 4377
  Gene Symbol: CYBB
  Gene Name: cytochrome b-245, beta polypeptide
  Uniprot ID: P04839
  ENST ID: ENST00000378588
  CDS Start-End: 68-1780
ttcctcattggaagaagaagcatagtatagaagaaaggcaaacacaacacattcaacctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttc

SEQ ID NO: 124143 - DNA, 3509 bp, Homo sapiens
  Payload ID: 4378
  Gene Symbol: CYB5D1
  Gene Name: cytochrome b5 domain containing 1
  Uniprot ID: Q6P9G0
  ENST ID: ENST00000332439
  CDS Start-End: 153-839
gacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtccttcgaaactttggaaagtttaatagctcaaagccacactaggtagtaaccactagagccagaatgcaaattcaagtctgcccaactccaaagtccatgttctctcaatataaagggaccatctcaatgtctaatctcatgttaacatttgtagccactgctctcagcaagtatttgggatgtggctttgtcctaggatccctgcacaataggaaattgtggtcctattgtatagtttgcagttattgtctctggaagggagtttgcagagttctcctgtggcgaagaggaggcaaggaaggctaagtgtcagttaagcaatagctattggggctacttctttgttaatcccataccccagatttctctcctgaccttttggggcaaagaggtgggtatttactaacttgaaggaaaactagagtggggaaaaggccggcaaattagtgacactttggcgagggagaaaaaggaggcagtttgccacttggagaagatgaggaagacagggttgcaagacggtgactccaaaagagggagctcgacaggggtaatgtaaacagagatgctaactaagtcagaaaactctcctggtgaccaaaagagaaccactattgggggtaatggctagatttggtctcctttaacttaaggaggggagatttgagaatgacagacagttgaacttcctggcagcagcaagcaaaaaacaaatcaggaagagtttagtgtgtcttctggcaggggacaccagggcccagcacaggagaaggtggcccctgtgagatactggtgggctatataggcattttctgaggggctttgggaggcatgaacaaaggtggaaacattgctgttggcttcggcagtatctgaatttactgtgagatggagggtttaaatctaaccccatggaatgcaggagtccatgaattatctaaatcgatcattttgatctttaatcaactctgcaattatgtgtaccttgtttgctcaattaaaccctgaactatttgagaatgaaagctatgctgttcctctagtgcaagcctcagggcctgtcctgtgcctacaggatgtccccattctgccaaaacctgtccctcttccagagactcctacttcaatgtctcttgctagaaacacatccctttcctcacacatccagtcactcatcaagtgtaatctgtctcctaaatatctctggaacctatcttcttttctccaagttaccatcacctcttgtctaaactgctacggaaacttcctaacctgttctcccatttccacttctgacttccatgctgcaatgagagtcagctatgaaaaacaaacctaaacatcgaactttccttagcttcttcagtggcttccaactgcttttggaataaagtcctaaattcaaagatcttgtataaatcaggctcatctcgcaacacccctctttgttctctatggcctagacacactggctttcagttcattacatgtcttgcctcagaccctcacacactgtcctctctgcctgcaacactcttcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactccaa

SEQ ID NO: 124144 - DNA, 1870 bp, Homo sapiens
  Payload ID: 4378
  Gene Symbol: CYB5D1
  Gene Name: cytochrome b5 domain containing 1
  Uniprot ID: Q6P9G0
  ENST ID: ENST00000571846
  CDS Start-End: 390-863
ctttcatactgcctcctcccttgtttttctgtctcagagagatagtctgtcctaaatatcccatgtagcccaggccactgaattaaaacggagcgtattcgttctctgccccaccccgcaactcctgaaagcggcgcaactcaattacttgatccttatatgccccacgcgggactcatactacgtttcccgtgaacacgtgcagtccaaaccccgcccctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctcttttttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtcctt

SEQ ID NO: 124145 - DNA, 538 bp, Homo sapiens
  Payload ID: 4378
  Gene Symbol: CYB5D1
  Gene Name: cytochrome b5 domain containing 1
  ENST ID: ENST00000574196
  CDS Start-End: 1-93
gaatacaagggtaagggccacacgttgggccggggccggagtgtgtgtgtgtgcacgcgcgcgtttgcctggttctcgaagggctggcattgacagtggctgtgctgctcttttcaagggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggaggtgggggttctggagtccatatgggaaatcctacaccgctatctcccctataactcacatgctgccagctacacgtggaaatatgaagggaagaacctgaacatggattttaccctggaagaga

SEQ ID NO: 124146 - DNA, 570 bp, Homo sapiens
  Payload ID: 4378
  Gene Symbol: CYB5D1
  Gene Name: cytochrome b5 domain containing 1
  ENST ID: ENST00000570446
  CDS Start-End: 106-408
ctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtgggggttctggagtccatatgggaaatcctacaccgctatctcccctataactcacatgctgccagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccct

SEQ ID NO: 124147 - DNA, 1910 bp, Homo sapiens
  Payload ID: 4379
  Gene Symbol: CYB5D2
  Gene Name: cytochrome b5 domain containing 2
  Uniprot ID: Q8WUJ1
  ENST ID: ENST00000301391
  CDS Start-End: 501-1295
gtggctcacgcctgtaatcccagcactttgggaggccgagacgggtggatcacctgaggtcaggagttcgagaccagcctgaccaacgtggtgaaaccctgtctctactaaatacaaaatattagccggacgtgggggcgcgtgcctgtaatcccagctacttgggaggctgaggcaggagaatcgcttgaacccgggaggcggaggttgcagtgagccgagattccgccagtgcactccagcctggacaacaagagctaaaactctgtctcagaaaaaaaaaaaaaaagtacctggaaaaagtcgcagacagcgagcttttcgccagtgccaggaatacagataaaacgagagagactaagggagggagcgcgagcactagcgcgcgagagagagagcgagagcgcgcgcgccgatgacgtcacgctcggcgtctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggagggtctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaacttaa

SEQ ID NO: 124148 - DNA, 694 bp, Homo sapiens
  Payload ID: 4379
  Gene Symbol: CYB5D2
  Gene Name: cytochrome b5 domain containing 2
  Uniprot ID: Q8WUJ1
  ENST ID: ENST00000577075
  CDS Start-End: 233-691
atctacgtcattccgtagcctccgctgccgccatctttgttggggctgacaacctgcaagccaagaagtacgagaagggccaggcgcggtggctcacgcctgtaatcccagcactttgggaggccgagacgggtggatcacctgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagcc

SEQ ID NO: 124149 - DNA, 1588 bp, Homo sapiens
  Payload ID: 4379
  Gene Symbol: CYB5D2
  Gene Name: cytochrome b5 domain containing 2
  Uniprot ID: Q8WUJ1
  ENST ID: ENST00000575251
  CDS Start-End: 640-1098
ggctgacaacctgcaagccaagaagtacgagaagggccaggcgcggtggctcacgcctgtaatcccagcactttgggaggccgagacgggtggatcacctgaggtcaggagttcgagaccagcctgaccaacgtggtgaaaccctgtctctactaaatacaaaatattagccggacgtgggggcgcgtgcctgtaatcccagctacttgggaggctgaggcaggagaatcgcttgaacccgggaggcggaggttgcagtgagccgagattccgccagtgcactccagcctggacaacaagagctaaaactctgtctcagaaaaaaaaaaaaaaagtacctggaaaaagtcgcagacagcgagcttttcgccagtgccaggaatacagataaaacgagagagactaagggagggagcgcgagcactagcgcgcgagagagagagcgagagcgcgcgcgccgatgacgtcacgctcggcgtctcggccatcttagctgtagatagaggcggcaacctcggaagtgcggagcgggtgggcctatatagatgttgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggagggtctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcac

SEQ ID NO: 124150 - DNA, 495 bp, Homo sapiens
  Payload ID: 4379
  Gene Symbol: CYB5D2
  Gene Name: cytochrome b5 domain containing 2
  ENST ID: ENST00000573984
  CDS Start-End: 149-469
agctgtagatagaggcggcaacctcggaagtgcggagcgggtgggcctatatagatgttgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagaggggttttaacagctctcttgccctcgcttctgggagcctcaagcatgcgtgtcacagactgattctgcaattcctgtgaaacctgttcctttggatccaaatgca

SEQ ID NO: 124151 - DNA, 1651 bp, Homo sapiens
  Payload ID: 4380
  Gene Symbol: CYB5R1
  Gene Name: cytochrome b5 reductase 1
  Uniprot ID: Q9UHQ9
  ENST ID: ENST00000367249
  CDS Start-End: 76-993
cgccctccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaagggt

SEQ ID NO: 124152 - DNA, 680 bp, Homo sapiens
  Payload ID: 4380
  Gene Symbol: CYB5R1
  Gene Name: cytochrome b5 reductase 1
  ENST ID: ENST00000446185
  CDS Start-End: 1-680
ccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaaggtatccttcccatttctggacatcccactatcccctcatcgtcaaaatcaaagccttgcccctttgtgaattctggcttcattgaaatcaaccttgcctcacactgccaactcggaagtctgagtgcacagacacagtga

SEQ ID NO: 124153 - DNA, 1254 bp, Homo sapiens
  Payload ID: 4381
  Gene Symbol: CYB5R2
  Gene Name: cytochrome b5 reductase 2
  Uniprot ID: Q6BCY4
  ENST ID: ENST00000299498
  CDS Start-End: 150-980
tgagactccagtgacccggcgggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcagaca

SEQ ID NO: 124154 - DNA, 579 bp, Homo sapiens
  Payload ID: 4381
  Gene Symbol: CYB5R2
  Gene Name: cytochrome b5 reductase 2
  ENST ID: ENST00000436351
  CDS Start-End: 231-579
gagcggcccccggccaaccccagttcgacgacgtgttgggcgtctcactccgggtgggttccgcggcggggtgtatttatggagtattgaagaaatatctccgtcgggacggccggaaggaaagaggccagaggcgcggaggccggctagagccgggaacgaacgacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatctttt

SEQ ID NO: 124155 - DNA, 797 bp, Homo sapiens
  Payload ID: 4381
  Gene Symbol: CYB5R2
  Gene Name: cytochrome b5 reductase 2
  ENST ID: ENST00000524608
  CDS Start-End: 230-797
gaagaaggatgtgttcacttcccctttcgccatgattttataagtttcctgaggcctccccagccaagctgaactgtcctgaggcaagaatttgcctttgcctgtaatcaagggcgagccgggcagccaaggttccgaaacgcaccgtgaagaccctctaactgtgcctactattctgctcccctccgatcggcgcggggctcttgtccttcctctctccacccagcgaatgaatgaacgcaggagcgctcggagtacacgtcttcaactcggcgacgcccctgcttcggccccaccccgcaaacacccgccccggaccaggcccagggtaggcgcccatgaggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccag

SEQ ID NO: 124156 - DNA, 611 bp, Homo sapiens
  Payload ID: 4381
  Gene Symbol: CYB5R2
  Gene Name: cytochrome b5 reductase 2
  ENST ID: ENST00000527542
  CDS Start-End: 174-611
gaatgaatatattcgcgcgctctttgcagctgcctgaattcttccttccccagcatccccctccgcccggtcacccagacggccttctccagccttgccgagcttaagacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactg

SEQ ID NO: 124157 - DNA, 872 bp, Homo sapiens
  Payload ID: 4381
  Gene Symbol: CYB5R2
  Gene Name: cytochrome b5 reductase 2
  ENST ID: ENST00000531096
  CDS Start-End: 359-872
agggtaggcgcccatgaggtatgtcgaatgaatatattcgcgcgctctttgcagctgcctgaattcttccttccccagcatccccctccgcccggtcacccagacggccttctccagccttgccgagcttaagtaagctgaggggcgctcagtgtggcagctctgcgtgtgcagggaaggggccaggatgcagaggggcagcgcaggagcgaggacgccacggctcagcgccccgccagcctcatgatggagcgctgccctgggggcagggctgacccagagccagcggctcgacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaagg

SEQ ID NO: 124158 - DNA, 1338 bp, Homo sapiens
  Payload ID: 4381
  Gene Symbol: CYB5R2
  Gene Name: cytochrome b5 reductase 2
  Uniprot ID: Q6BCY4
  ENST ID: ENST00000524790
  CDS Start-End: 121-834
ggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggtccctggtcggcagagggcgctaccctactgagcaattctgcgcagttccactaacaccaggccacaccctgccggacaactccagctggctgtactgattcacacacctcggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcagaca

SEQ ID NO: 124159 - DNA, 1658 bp, Homo sapiens
  Payload ID: 4381
  Gene Symbol: CYB5R2
  Gene Name: cytochrome b5 reductase 2
  Uniprot ID: Q6BCY4
  ENST ID: ENST00000533558
  CDS Start-End: 558-1388
attcgcgcgctctttgcagctgcctgaattcttccttccccagcatccccctccgcccggtcacccagacggccttctccagccttgccgagcttaagtaagctgaggggcgctcagtgtggcagctctgcgtgtgcagggaaggggccaggatgcagaggggcagcgcaggagcgaggacgccacggctcagcgccccgccagcctcatgatggagcgctgccctgggggcagggctgacccagagccagcggctcgtgagtgagagccccccgaccacggcccttctcggggagcgggccagccgccggggtcccagcctgcggggtccgcccgcgcttttgtcctcccgggcgtgcgtgtccgggtctcggccggttccccgtcggccaggcggagctgcggggcgacgccacgagtctgcgggcccgcggcggggagcggcccccggccaaccccagttcgacgacgtgttgggcgtctcactccgggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagca

SEQ ID NO: 124160 - DNA, 2124 bp, Homo sapiens
  Payload ID: 4382
  Gene Symbol: CYB5R3
  Gene Name: cytochrome b5 reductase 3
  Uniprot ID: P00387
  ENST ID: ENST00000352397
  CDS Start-End: 254-1159
gaggccaccgtcccgcgcggggcagcacagcggcgggagagctcggagcgcagagggccgcatccccagttcccagtctccatccccggcagaagcaggcggagcgacccggtccccgcccccgcgcccgccccgccccgcgcgcccgcctggcccctcggccccgcccctgctccggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaccctt

SEQ ID NO: 124161 - DNA, 2938 bp, Homo sapiens
  Payload ID: 4382
  Gene Symbol: CYB5R3
  Gene Name: cytochrome b5 reductase 3
  Uniprot ID: P00387
  ENST ID: ENST00000361740
  CDS Start-End: 1-1005
atgaataggagtttgctggttggatgcatgcagagcaaggacatttggggcagagaggagagcatatgcgaacgcctgaagcaagatgggcttgatgttgaaagagcagagagctgggagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaacccttctctagctcctcgagggtctgtgacctgcaacacaaggggtggggtcaggaaagggctggggaagacctagcattttttttttcttttttttttttttttgagacggagtctccctttgtcacccaggctggagtggcatgatctcagctcactacaacctccacctctcgggttcaagcgattctcctgcctcagcctcccgagtagctgggactaaaagtgcccaccaccacacccagctagtttttgtatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggctccagcatttatttctgatgtatctttgtggtagaaaatttggaaagtgcagagaagtatacacaggaagaaaaattcccaacccccagaggcaaaccagctgaaaccacgcaaccccagtcaccccaatgcaccgcgaggctgctgcctcctgtcagggtcagatgagcctcgaggctcaggaaagtcagaggatgccatctgcatggtggtaaattacagaggtgatgaggcaaggtgggtgtggggctgttcttaaaacggggcagcaggaaggccccaaggagatggatttgggctgggacgggaagagagagctggccatgctggggtgggtgggtgttcaaatggtggaaacagcagacgcaaaggccctgccgttggaaccagcttgtggaataaactttcagaaacaga

SEQ ID NO: 124162 - DNA, 1849 bp, Homo sapiens
  Payload ID: 4382
  Gene Symbol: CYB5R3
  Gene Name: cytochrome b5 reductase 3
  Uniprot ID: P00387
  ENST ID: ENST00000407332
  CDS Start-End: 93-929
aaaggcaggctcctgcactgaccccgcgggtcctgtcgtttcagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcattt

SEQ ID NO: 124163 - DNA, 2153 bp, Homo sapiens
  Payload ID: 4382
  Gene Symbol: CYB5R3
  Gene Name: cytochrome b5 reductase 3
  Uniprot ID: P00387
  ENST ID: ENST00000407623
  CDS Start-End: 386-1222
aaaacattggagcttggtctgccatcctgaactgtggttcccctgcctcccagcccggctgtgagtgctcagcgaccctgacaggctgacaggtacagtctgccgggctttcctactgtccctggcagccccatgcttactctgcggcccagatcccagctctgtgtccacctgttccttctcctgggttcccttcccccacagttcccagccaagccagagccccccactgcagaacttcctccactccctcccacttcctcccggttagaacaggaccaggagggaggtgccgctcagattctggcaggaccgctggcgggcaggcaggggacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaa

SEQ ID NO: 124164 - DNA, 1050 bp, Homo sapiens
  Payload ID: 4382
  Gene Symbol: CYB5R3
  Gene Name: cytochrome b5 reductase 3
  Uniprot ID: P00387
  ENST ID: ENST00000402438
  CDS Start-End: 185-1021
tctgccatcctgaactgtggttcccctgcctcccagcccggctgtgagtgctcagcgaccctgacaggctgacaggaccaggagggaggtgccgctcagattctggcaggaccgctggcgggcaggcaggggacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgc

SEQ ID NO: 124165 - DNA, 675 bp, Homo sapiens
  Payload ID: 4382
  Gene Symbol: CYB5R3
  Gene Name: cytochrome b5 reductase 3
  ENST ID: ENST00000438270
  CDS Start-End: 234-675
atctaagacatgcaggccccatgggaggcctctcccaacactttgtgggatccaggccaggggttggccctggagtctgccagccacactgggaaaacattggagcttggtctgccatcctgaactgtggttcccctgcctcccagcccggctgtgagtgctcagcgaccctgacaggctgacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcagga

SEQ ID NO: 124166 - DNA, 768 bp, Homo sapiens
  Payload ID: 4383
  Gene Symbol: CYB5R4
  Gene Name: cytochrome b5 reductase 4
  ENST ID: ENST00000369679
  CDS Start-End: 230-559
gcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaaggcaaactctggcacctgtagagctgaggatggagatagacaccaggacctatagtgggctgagacattactttcaaagatttcttttactgtcacagcactgtgagcaaggacaagacatctattgaatgggctgcctgccagttggaagttcaacttttgtaaagtcagtcaaagttctttcttctagaagcctcagtttcctcattggtaaaatggagacaatttag

SEQ ID NO: 124167 - DNA, 9252 bp, Homo sapiens
  Payload ID: 4383
  Gene Symbol: CYB5R4
  Gene Name: cytochrome b5 reductase 4
  Uniprot ID: Q7L1T6
  ENST ID: ENST00000369681
  CDS Start-End: 141-1706
tgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaagactatcgtgaggaggaaaagaaagtcttaaatggcatgcttcccaagagccaagtgacagatacacttgccaaagaaggtcctagttatccaagctatgattggttccaaacagactctttagtcaccattgccatatatactaaacagaaggatatcaatttagactcaataatagttgatcatcagaatgattcctttagagcagaaacaattattaaggattgtttatatcttatacatattgggctaagccatgaggttcaggaagatttttctgtgcgggttgttgagagtgtgggaaaaatagagattgttctacaaaaaaaagagaatacttcttgggactttcttggccatcccctgaagaatcataattcacttattccaaggaaagatacaggtttgtactacagaaagtgccagttaatttccaaggaagatgttactcatgatacgaggcttttctgtttgatgctgccaccaagcactcatcttcaagtgcccattgggcaacatgtttacctcaagctacctattacaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggagattttgtttctgtaagcagtcctgagggcaattttaaaatatccaagttccaagaattagaagatctctttttgttggcagctggaacaggcttcacaccaatggttaaaatactgaattatgctttgactgatatacccagtctcaggaaagtgaagctgatgttcttcaataaaacagaagatgatataatttggagaagccaattggagaaattagcatttaaagataaaagactggatgttgaatttgttctctcagcacctatttctgaatggaatggcaaacagggacatatttcaccagctcttctttctgaatttttgaaaagaaatttggacaaatccaaagttctcgtctgcatttgtggaccagtgccatttacagaacaaggagtaaggttgctgcatgatctcaacttttccaaaaatgagatccatagttttacagcataatgaagagctgtcattgtcctttattcaactagtttatctaaatttgtgattgcttagggttttttaagagaacatttttgtacataacaaaaggttaactagaatccagccttcagtttcttaaatgaaatcaaatgttccttcagtacaggtaacttcttggctttcttttgtaccacaacttattttactactgatatttgacctggaaagttaatcatggcaacaaatacatacaggattctttgttatgaatcacaaatttccttgccatttaaattatatcactgttctacaataagcacttgtgttttatgacatgataaagtaaatgatcacttcgatcatgtttctatgctgtaaaatgtcttattagcaatacagattaaattttaccttgcactgttaactcaggaaatgatcatttatgtccttgttattaatgttaaaacatagaatgttataacttattaagtgatccaaacatttttttgtgtgtgtatggcattgatgcagaatagaataaaattatacttaagttctttttaatccttgtggtagaaatgtggttgaatgcaacaatattgggccagcgtctcaaggggaattttaaaaggcagcaataaaatatattagagacatgacacacatgcgcctttggactaggtgtgttaacagagcttgagagagggaaccttgacagctatttttactcttagccaaaaacaaagacattaggaaagagagtgaaagtatagtgtctagttccacagcataaagttattatttggtgctttggaatgggttgaattttaattctttagtccatctaaatcagctggaaaaatgaggaacattctgccttgaatggttcttcccctggttggctgctttctccacaactggtggttcagcaggaagccctcttaggttcttgcatgtgggcaacttattttctcttcctgctgctttgtgcaactgtcaaatactttcacagattcagatcagcaaagggtatcaaggatagtcattgtgagcttttcgtgaggaaactgttgaatgcataggtagctactgtataagctaactaggatttttcagtcttagtacagctgcaatgttttcacagaaataggggattgaaagagtctccaatttctctgtaaatgattttgtaaacagctaaatctttgctgaatgaataatatactcaagaggaacacaatattaatattccccaaattacagacgcccagcttgtgaagcttcctatgtgcaaatggctggttgaacactatcactttttcctgtgcctctgtcttctgtagccaattccaccatcatcattattcacaaagacaggaatctagctgtcctggactggtactgttccctggtaggtaacaagaactttttctagcttcatgccttccccctacttatttttttccatctaagggtgaggtgatttggctctgtgtcctcacccaaatctcctctcaaattgtaattcccacatgtcgagggagggtcttggtgggaggtgattggatcatgggagtgattgcccccatgctgttctcatgatggtaagtgagttctcatgagatctgatggtttaaaagtgtggcacttcctccccacctcctgctgtattatgaagaaggtccttgcttcttctttgctttctaccataattgtacatttcctgaggcctccccagccatgcagaactgtgagtcaattaaacctcttttcttcataaattacccagtctcaggtagttctttatagcagtgtgaaaatagactaatataaaaagagactatttaccacttttttttagttcatttgcgatgtatcaaatctaacttagccaacatctttctcatcttttctaagcctcttcttttttctctctcctttcccaagcaacagaatctcctattagtcgctatatgtaatgcttcctcattcctccttttatgttttatatttttgtttatattttatttatattttgtttatattttgttatattttattatattttgttatatttatattttgtttatattttaaaacaaatccataagtgtctcctgggtaatctccactgacatgattttatcaacttacatgttaattcccaaatgggagtgactaatttgagaatcagctgagcttcagttttcaatatccatttacttcctgcataccaccccaccatccacctagtaagccattctagaactattaggaatcaacatcaatgtccccttctccagtctgactcttccataccagctaaccctgtcctatcatccctcagctggattagtacagtagcttgataattcatcttcatgctgcagtcctgatctcctaaaattcattctccattccagggtattctagaaggacttggaggaaaaaatcccctaagtagagcctcagtcttccaatgaatgcaaccaaatactgaggagcacagataggagtatagtttatcactgttattctcaagcaaataactcaaagactcctacatcacatatttgcagtgaagaagaattacgctcaaagtcacatttgcttgcaaattctgctttttttaaaaaaaagtttattaattttctattgctgctagatcaaattactacaaacttagtagcttaaaacaacacccatttattatctcacagttccatggcacagaaatctaggcacaatatggctcaactgggtcctctgcttaaagcctcacaaggctgtaatcagattgtcagctgagctgggctcttagctagaggctgtaaggggaagtccctagataagagttctttcagcctcattaggtagatttcagttccttgcagttgtaggactgagttccccatttccttgctagctgttagctgtgggctagtctttgtttctagaatttgcccacattccttctcatactttctgtgtggccctcttcagcattagtggatgaatctcatgctttcagtctctctgaattcccttgtgggcttcttcagcattggtagatgaatcttatgctttcaatctctctgaattccctttctgccatatctttcttgccctagcaagagttcactgcttttaagatctcatgtggttagattggacctatccagatatccagggtaatcttcctattttaaaaatctataattttaattatagctgtaaagtcccttttcctatataatatattcaaaggttgcaggcatttgggtgttgacatctttgatgggcacattgtgtctaccacaggctatagaaagaacagagaaatttgtccaagataagatgattaggttttgtctagataggggcccttgctatgggccctcagtttttaccttaatgtaacagaacatgagaggagctttgacacccaccccaaaagagtcaacttcattatgctggcaaaggcatgggtacaacctgctctgtgatctaccttctgaaccacacaagcttgtcctgaacgaggttggggctgagtctgttgataacagacccccatttttgggcagaaaaaacagattctgtatgatctacagtatttaacattgtggcaaataaattataaaggaaaaatggaatctcaagtagttacagtctcttggtgtctttcaacattggttttattttgaagtcattttcacccagcattgcaagtttagcagacctcaaaacagaatgccaaagtgatcttaaaattcaaaaatgagtttactttctttgttaaagttctcttttgatgcatatcccccattcatggaatggaagcattatcttgggtgcagcattacacgtagagttaaaatgtggaaacaacccaaacatcctgatatggtttggctctgtgtcaccacccaaatctcatcttgaattgtactctcataattcccatgtgttgtgggaggaacccagtgggagataatttgaatcatgggggcagtttccctcatactgttctcatggtagtgaataactctcacaagacctggtggttttatcaggggtttccgcttttgcatcttactcattttctcttgcggccgccatgtaagaagtgcctttcacctcctgccatgattctgaggcctccccagccatgtggaactgtaagtccaattaaacccctttttttccccagtctcaggtacgtcttttatcagcagcgtgaaaatggactaatacagtaaattggtaccagtagagcaggtgttgctgcaaagataccgggaaatgtggaagcaactttggaacttggtaacaggcagagattggaacagtttggagggctcagaagaagacaggaaaatgggaaagtttggaacttccttgagacttgttgaatggctttgacaaaaatactgataatgatatggacaatgaaatctagactgaggtggtctcaggtggagatgaggaacctgttgagaactggagcaaaggtgactcttgttatgatttagcaaagagactggcggcattttgcccctgccctggagatttgtggaactctgaacttgagagagatgattaagggtatctggtggaagaaatttctaagcagcaaagcattcaagaggtgactcaagtgttgttaaaggcattcagttttaaaagggaagcagagcattaaaattcagaaaattagcagcttgacaatgcgatagaaaagaaaatcctattttctgaggagaaattcaagctggctgtagatatttgcataagtaacaaggaactgaatgttaatttccaagacaatggggaaaatgtctccagggcatgtcagagacatttgtggcagcctcttctatcacagacctggaggtctaggaagaaaaaatggtaaaaatggttttgtgggcaaggcctagggtccttgtgctgtgtgcagtctaaggacttggtgccctgtttcctagccactccggccatggctgaaaggggccaacatgaagctcaggccatggcttcagagggtgaaagccttaagccttggcaacttccatgtgatgttgagcatgtgggtgcacagaagtcaagaaatggggtttgggaacctctgtctagatttcagaagatgtatggaaatgcctggatgcccaggcagaagtttgctgcaggggcggggctctcatggagaacctcggctagggcagtgcagaagggaaatgtggggttggagccccctcacagagtccctactgggacaccgcctagtggagctgtgagaagaggaccactgtcctccagaccccagaatggtagatcgacttacagcttgtaccaggtgcctggaaaagctgcagatactcaacaccagcccatgaaagcagccaggatggaggctgtaccctgaaagccacagggccagagctgcccaagaccatgggaagccacctcttgcatcagcgtgacctggatgtgagacctggagtaaaaggagatcattttggagctttaaaatttgactgccccactggattttggacttccatgggccctgtaacccctttgttttggccaatttctcccatttggaatggctgtatttacccaatacctgtaccctcattgtatctaggaagtaactagcttgcttttgattttacaggctcataagtggaagggacttgccttgtctcagatgagacttttgaactgtggacttttgggttaatgctgaaatgatttaagactttggggtactgttgggaatgcatgattggttttgaaatgtgaggacataagatttggaggagccaggggtgggatgatatggtttggctctgtgtccccacccaaatttcatcttgaattatactcccataattcccatgtgttatacgtgggacctggtgggagataatttgaatcatgggggtggtttcccccatactgttctcatggtagagaataagtctcatgagatctgatggtttcatcagggggttccgcttttgcatcttactcatttctcttgctgccaccctgtaagaagtatttttaacctaccgccatgattctgaggcctccccagccatgtggaactataagtccaattaaacctctttttcttggcttaatttcttgggtatgtctttatcagcagtgattctattcctatgaaatgtctagaacaggaaaatctatgagacataaagtaattaagtggctgttcaggggatacaggaataggggataataactaaagggttgggagggtgtttttgaaatgctaaaatattctgaagtttactgtggttatggttgcacatacttatgaatatacctaaaaatgttgaattgtacattttaagtagatgaattgtatctaatttgaaccatatctcagtaaagatataaaaatgtttttgggtactaagactaaactagaaagaacataagaggaaatacatattatataagaagaaaagagtaaaaataaatctttaaaaaaataaaaataaaaaggaggcctgtgtgcggtggctcatgcctgtaatcccagcactttgggaggccgaggcgggtggatcacctgaggtcgggagtttgagaccagcctgaccaacatggagaaaccctctctctactaaaaatacaaaattagccaggtgtggtagcataggcctgtaatccctgctacttgggaggctgaggcaggataattgcctgaacccgggaggcggaggttgcggtgagccgagattgcacctttgcactccagcctgggcaacaagagtgaaactccatctcaaaaaataaaacaaataaaaaggattctagaggaagtggtaaatagtgaagataggcaaagaatatccaacatatgaataatagtagtccttgaagacaaaaatcaaaggaaaagaatactaaaaactctacttaatgaaaaatcatcctgaaattaacaagaaaaattgaaattaatgttgaaagagcaccagagagtatacatccaaaaagaccaacattaatataaattttagtaaaattactgaaccatgaaaagtaaatgcctttagttatctaaacaaaaactaattacttaaaagggaaagaaaattagatcatcaccagacttttcaacagcattgccttatgctttaagaaagtgttgtaccacatttgatatcctgatggaaaaaaatgtgagccaaggattttacacccaacaaaacttaatggtgaatataaaggcataaaccaatatagaatgcaaaaacttgggaaatattgttttccaaagcctttcctaagtaatctacaaaagaacaagctttaaacaaccagaaagactagaaagtcatcaataaaaggattggagaacattaaacttgtagaactaaaacaaaatgagagttaaaaaagaaagagtataggtatatgctaaactatttcagtagttttggcagtggttgtattagtattgttattctgaagatgtgaaataatgcaaacgcataataaaaaatgtcatctggtc

SEQ ID NO: 124168 - DNA, 985 bp, Homo sapiens
  Payload ID: 4384
  Gene Symbol: CYB5RL
  Gene Name: cytochrome b5 reductase-like
  Uniprot ID: Q6IPT4
  ENST ID: ENST00000287899
  CDS Start-End: 66-809
catagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgagg

SEQ ID NO: 124169 - DNA, 3339 bp, Homo sapiens
  Payload ID: 4384
  Gene Symbol: CYB5RL
  Gene Name: cytochrome b5 reductase-like
  ENST ID: ENST00000421415
  CDS Start-End: 258-470
aaaatcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtcacatttaataaataattgtgacacatagctggggggtggtgctggaggtttcagaccgcctcacaggcagagttccagggtcagagagcatggagtactgtgtgtgaccttcttccagaagcacgggcacaggagcatgttaaaggccctgaaaagaccagtggcaaagaaactcctttcattttgtttaatccagagtttttcaagcttatttaactatagaacacttttctgtgggtttcgtagcctctttctagcacagtatagtgagtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatcctattgactcagctccaaatagcgggggcctgtcaggagcctgactctgttcagacaccagggaaacaacagcacaccaggcagatgcagttatgtccatcggggaacttacagcctagcaaggaaggcagcaattcaacctgtaagtctaaaagtgatgggtgtcatgaaaaggtaagtgcagggtgctgggagagtggttggcaggggctttagcctagtctagggagagcccaggggcacaccactgccagcggggatagaggcttcaaaagctttgaagtcactcatattaagagtgttgccggacacggtggctcatgcctgtaatcccagcactttgggaggctgcggcaggcagattgcctgagcccagaagttcgaggccagcctggccaacatgacaaaaccctgtctctacaaaaaaaaaaaaaaaaaaaa

SEQ ID NO: 124170 - DNA, 3415 bp, Homo sapiens
  Payload ID: 4384
  Gene Symbol: CYB5RL
  Gene Name: cytochrome b5 reductase-like
  ENST ID: ENST00000420054
  CDS Start-End: 23-190
cgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagatgaagaaactgaagctcaaaaagatgacatcatttgtctcaaggcctcttgggtaatatgatccaaatggaaggacaaaagttcagtgtcagttctgtttaacaatgctaccagatggggctgatgtcccggtatgttgagtcctggagagtaggagacacagctttctggcgaggacctttcggagatttcttctataaaccaaaccagatggaatcttgctctgttgcccaggctggagtgcagtggcatgatctcgactcactgcaacctctgcctcccaggctcaagcaattcttctgcctcagcctcccaagtagctgggactacaggcgtgcaccaccacgcttggctaatttttgtatttttagtagagacggagttttgccacgttggtctcgaactcctgaccttaagtgatccgcccaccttggcctcccaaagtactaggtttataggttatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtcacatttaataaataattgtgacacatagctggggggtggtgctggaggtttcagaccgcctcacaggcagagttccagggtcagagagcatggagtactgtgtgtgaccttcttccagaagcacgggcacaggagcatgttaaaggccctgaaaagaccagtggcaaagaaactcctttcattttgtttaatccagagtttttcaagcttatttaactatagaacacttttctgtgggtttcgtagcctctttctagcacagtatagtgagtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatcctattgactcagctccaaatagcgggggcctgtcaggagcctgactctgttcagacaccagggaaacaacagcacaccaggcagatgcagttatgtccatcggggaacttacagcctagcaaggaaggcagcaattcaacctgtaagtctaaaagtgatgggtgtcatgaaaaggtaagtgcagggtgctgggagagtggttggcaggggctttagcctagtctagggagagcccaggggcacaccactgccagcggggatagaggcttcaaaagctttgaagtcactcatattaagagtgttgccggacacggtggctcatgcctgtaatcccagcactttgggaggctgcggcaggcagattgcctgagcccagaagttcgaggccagcctggccaacatgacaaaaccctgtctctacaaaaaaaaaaaaaaaaaaaa

SEQ ID NO: 124171 - DNA, 679 bp, Homo sapiens
  Payload ID: 4384
  Gene Symbol: CYB5RL
  Gene Name: cytochrome b5 reductase-like
  ENST ID: ENST00000497820
  CDS Start-End: 136-552
gactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcaggtagcgggaggaccaaagcttcacagccctgctttgctatttgctagctgctggccttgaccaactagcgtactctcccttaagcctccatttgtcatcttcaagatagacatagtgacacatgactcagagagttcttgggattgaactagataatgcattttcataataaataataacacaatca

SEQ ID NO: 124172 - DNA, 2642 bp, Homo sapiens
  Payload ID: 4384
  Gene Symbol: CYB5RL
  Gene Name: cytochrome b5 reductase-like
  ENST ID: ENST00000528287
  CDS Start-End: 284-655
ctacccagagactgggaggaacctggaaaatcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcagagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaa

SEQ ID NO: 124173 - DNA, 1148 bp, Homo sapiens
  Payload ID: 4384
  Gene Symbol: CYB5RL
  Gene Name: cytochrome b5 reductase-like
  Uniprot ID: Q6IPT4
  ENST ID: ENST00000534324
  CDS Start-End: 1-948
atgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctccta

SEQ ID NO: 124174 - DNA, 602 bp, Homo sapiens
  Payload ID: 4384
  Gene Symbol: CYB5RL
  Gene Name: cytochrome b5 reductase-like
  ENST ID: ENST00000493530
  CDS Start-End: 1-531
cgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggtacactcagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccagttggttgaatccacaaatgtggaacccatggatacagagggctaactgtatacttaatgatttgtatacttttctacacatatgttgtactccaataaaatgttcatttaaaaaaa

SEQ ID NO: 124175 - DNA, 718 bp, Homo sapiens
  Payload ID: 4385
  Gene Symbol: CYB5A
  Gene Name: cytochrome b5 type A (microsomal)
  ENST ID: ENST00000299438
  CDS Start-End: 248-430
ggctcggtgttaattaaccttttccagtcacgccttggcagccaggtgccgtgcttgactcctgagaccgcggtgtgtggctggagcaagaacacagaggccaggcagagcagcggacgttctgcgtgggactcgcccctaacagctttggaagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 124176 - DNA, 3283 bp, Homo sapiens
  Payload ID: 4385
  Gene Symbol: CYB5A
  Gene Name: cytochrome b5 type A (microsomal)
  Uniprot ID: P00167
  ENST ID: ENST00000340533
  CDS Start-End: 142-546
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaccgtgtttgcctgtttggtgtataattgtctttaatgtttagaatctggttatttagaggattccttcaatgtgttactcatccagacccacagaggccatatgactggaggtgcgggaaataggtttgagtgtctcctttcacatcgtcacatctcattgagtaaccatgtattgtatgcttccgatatagtttctttttttcaaggaaattaagaaaggccagaaattatagtttaaggatttctaataattgtcctacttgaaatagatcttaaaaagaaagtagcggctgggcatcgtggctcacacctgtaagcccagcactttgggaggctgaggtgggtggatcacttgaggtcaggagttcaagaccagcctgaccaacatggtgaaaccctgtctctactaaaaatacaaaattagcagggcgtagtggcgcatgcctgtaatcccggctacttgggaggctgaggcaggagaattgcttgaacccaggaggcagaggttgtagtgagctgagatcgcgccgttgaactccagctgggcaacaagagtgaaactctgtctcaaaaaaaaaagaaagtagcctacagggcctataagagagacttcttatcttcactgattgaaaaacatcagcaacttaaaaacacatgaaccatgagagggcatcgcaactgtccattctctcagcttacacgtatcattgcaaaggcactcacagcttcataggttctaaagttttaagaattcctcattcagagagtagaattgtttgtaaactcttctaaggaaaggctggttttctaatttgtaaggagattgtgggacattggaatctgatctttgaagaaatttagcggctagtgtcaagctctgaagagttctggtgtggctctgtctcctcctgggggctctaaggggctgattcagtcatcttacttcccatttattattctctgccttatgtgttattcttttaaatgtggaaacttgaaagctgaatttgttagaacccagtacatgtgtcattggctgtgactgcatttgcactggcatgagctgacaaaccacgaggttcttcagaagtgaccgcgtgcagtggaaaggaattgtgttgttcttacagagtacaacctttataatcaaataggatgcaccgcctttgccttctttagtcactgaaagttgacaagtagtttctatttcaaaataaattacaacacttgttaagggacctatgtaaatatttcaatatttttggttgtgatttttagctataaagcttcacattttagtagtttttaaaacattgctcctaaatcaactatgaagtgaatcgaagtgggtcagtcgtaccttagatgacattaaagggttaacttgtaaatcatttttaagatgttgagtaatagcatctgtatatcgttaagaaacataacagttgaactttgacatttttatcagtgactcagcaatttgctgctgtggctggcaatgtttcttcatgtgttttgggaacaacatgtggagtaaaggagagtttacttcctaattttaacatttacagtttgtgcagccagactctcaaggaaagatatttgacacttttttctctattgctttcccttcagagaggtgagagacttcagaggctgccctttcttttcatctgctgcttgtgaaaggaaaacatcttgggcccccagaatcactaaggaaaactcaagctggaaactgcttagggccaacctgcctcccattctactcagtcaagcctctgctcactgagagagaggcatatctgattgcttcctttggaaaggctaatcagaaactcagaagaatgcaaccctttgtgtctcacctctctgtgacctggaagctccctcctgctttgagtcttcctgcctttgcttcaaggtgtcccgcctttccaaacagaaccaatgtacttcttacatatattgatcaatgtctcatgtctccctaaaatgcataaaaccaagctgtgccctgaccaccttgggtacatgtcattaggacctcctgatgctttgtcacgggcatgtcctcaaccttggcaaagtaaactttcttttttttttttttttgtttttgagacagagtctcactctgtcgcccaggctggagtgcagtggtatgatcttggctcactgcaacctccgactcccaggttcaagtgattctcctgccccagcctcctgagtagctgggactacaggcgtatgccaccatgcctagctaatttttttgtatttttagtagagacgggatttcaccatgttagccaggctggtcttgaactcctgacctcaggcaatccacccgcctcaggctcgcaaagtgctggaattacaggcatgagccactgtgccgggcctattccttgactttcttaataaagttgttttcactttgc

SEQ ID NO: 124177 - DNA, 619 bp, Homo sapiens
  Payload ID: 4385
  Gene Symbol: CYB5A
  Gene Name: cytochrome b5 type A (microsomal)
  Uniprot ID: P00167
  ENST ID: ENST00000397914
  CDS Start-End: 99-473
ccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaac

SEQ ID NO: 124178 - DNA, 776 bp, Homo sapiens
  Payload ID: 4385
  Gene Symbol: CYB5A
  Gene Name: cytochrome b5 type A (microsomal)
  Uniprot ID: P00167
  ENST ID: ENST00000494131
  CDS Start-End: 61-357
gcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 124179 - DNA, 4286 bp, Homo sapiens
  Payload ID: 4386
  Gene Symbol: CYB5B
  Gene Name: cytochrome b5 type B (outer mitochondrial membrane)
  ENST ID: ENST00000307892
  CDS Start-End: 90-542
tgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttcctttt

SEQ ID NO: 124180 - DNA, 1658 bp, Homo sapiens
  Payload ID: 4386
  Gene Symbol: CYB5B
  Gene Name: cytochrome b5 type B (outer mitochondrial membrane)
  ENST ID: ENST00000515314
  CDS Start-End: 19-414
ggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccat

SEQ ID NO: 124181 - DNA, 4358 bp, Homo sapiens
  Payload ID: 4386
  Gene Symbol: CYB5B
  Gene Name: cytochrome b5 type B (outer mitochondrial membrane)
  Uniprot ID: O43169
  ENST ID: ENST00000512062
  CDS Start-End: 172-612
gaaaagaaaacgaaccaggaactattcggaagtgtgattggctgttgctaggaaccgtctcaaggccttatgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttccttttct

SEQ ID NO: 124182 - DNA, 823 bp, Homo sapiens
  Payload ID: 4386
  Gene Symbol: CYB5B
  Gene Name: cytochrome b5 type B (outer mitochondrial membrane)
  ENST ID: ENST00000561792
  CDS Start-End: 17-439
cagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaaggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttcc

SEQ ID NO: 124183 - DNA, 577 bp, Homo sapiens
  Payload ID: 4386
  Gene Symbol: CYB5B
  Gene Name: cytochrome b5 type B (outer mitochondrial membrane)
  ENST ID: ENST00000568237
  CDS Start-End: 1-195
aagcgcaactccttgaaggaactgtggcttgtgatccatgggcgagtctacgatgtcacccgcttcctcaacgaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttg

SEQ ID NO: 124184 - DNA, 3001 bp, Homo sapiens
  Payload ID: 4387
  Gene Symbol: CYB561
  Gene Name: cytochrome b561
  Uniprot ID: P49447
  ENST ID: ENST00000360793
  CDS Start-End: 148-903
acttccggtcccggagacaccgcccagcccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagcaga

SEQ ID NO: 124185 - DNA, 3007 bp, Homo sapiens
  Payload ID: 4387
  Gene Symbol: CYB561
  Gene Name: cytochrome b561
  Uniprot ID: P49447
  ENST ID: ENST00000392975
  CDS Start-End: 154-909
gacagacaacaagtgaccaggggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagcaga

SEQ ID NO: 124186 - DNA, 3151 bp, Homo sapiens
  Payload ID: 4387
  Gene Symbol: CYB561
  Gene Name: cytochrome b561
  Uniprot ID: P49447
  ENST ID: ENST00000392976
  CDS Start-End: 301-1056
aggtgagccctgactgcgcagggagggacagcgcggggctcccgagtagcagccggcctcgcacctgccccttgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagc

SEQ ID NO: 124187 - DNA, 1496 bp, Homo sapiens
  Payload ID: 4387
  Gene Symbol: CYB561
  Gene Name: cytochrome b561
  Uniprot ID: P49447
  ENST ID: ENST00000448884
  CDS Start-End: 61-477
acccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcaggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctca

SEQ ID NO: 124188 - DNA, 1302 bp, Homo sapiens
  Payload ID: 4387
  Gene Symbol: CYB561
  Gene Name: cytochrome b561
  ENST ID: ENST00000542042
  CDS Start-End: 84-1040
gaccagccccttccttcccgtcaaggagcgcgcttgcctgtgtaactcacctgtaaagcccacccagggaaggccagggcctcatgaaacagaaaacaaagccgggcactgggcccttgagctcactagaatttggggtatctttccttgcaccctcaccgcatatggaactcctggcgtcgtgtcccaggtcacgcctgtccccgtggggaggctgggcccctccccccagccactcccgagacttgagacctctgcctcaggacgatggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggactt

SEQ ID NO: 124189 - DNA, 2344 bp, Homo sapiens
  Payload ID: 4387
  Gene Symbol: CYB561
  Gene Name: cytochrome b561
  Uniprot ID: P49447
  ENST ID: ENST00000581573
  CDS Start-End: 403-1158
cgcatctcaggcgcagtctctaggggctgtgcgcatccgtgggggggacatgcgcatctcaggggggctgctcgcatctgggggtgctgtgtgcatctcgggggggctgtgcccatctagcggggtggctgtgcgcatctggagggggctgtgcgcaacccggggggggtgttgcgcgcatctagcaggggcggctgtgcgcatttcggggggggctgtgcatatctggggggaccgtgcttatctccgggggcggctgtgcgcatcttgaggggtgtgtacatctcggggggcctgtgcgcatcttggggggctgtgtgcatccgcgggggctgtgcgcatctcggggtgctgtgcgctgctcctctgagctctgctctttcttgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctac

SEQ ID NO: 124190 - DNA, 848 bp, Homo sapiens
  Payload ID: 4387
  Gene Symbol: CYB561
  Gene Name: cytochrome b561
  Uniprot ID: P49447
  ENST ID: ENST00000584291
  CDS Start-End: 94-848
agcgatgcttggctcagtgaagatctgcgggtcatgctgtccctaatgcgctgattgcattaagtggattctggctgcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtg

SEQ ID NO: 124191 - DNA, 1127 bp, Homo sapiens
  Payload ID: 4387
  Gene Symbol: CYB561
  Gene Name: cytochrome b561
  ENST ID: ENST00000580691
  CDS Start-End: 1-917
ctttccttgcaccctcaccgcatatggaactcctggcgtcgtgtcccaggtcacgcctgtccccgtggggaggctgggcccctccccccagccactcccgagacttgagacctctgcctcaggacgatgggtgggaaggggcttgcggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtg

SEQ ID NO: 124192 - DNA, 3200 bp, Homo sapiens
  Payload ID: 4387
  Gene Symbol: CYB561
  Gene Name: cytochrome b561
  ENST ID: ENST00000584031
  CDS Start-End: 301-885
aggtgagccctgactgcgcagggagggacagcgcggggctcccgagtagcagccggcctcgcacctgccccttgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggtgagttcccgggcgcggccttccccgccacctgcctgcctcttcaggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagcag

SEQ ID NO: 124193 - DNA, 481 bp, Homo sapiens
  Payload ID: 4387
  Gene Symbol: CYB561
  Gene Name: cytochrome b561
  ENST ID: ENST00000580592
  CDS Start-End: 198-481
agcacttctttcagtacattttcctgttagactcggggtattagagacccaaagatacccaaggaggagtgagagcgtccctgccttcgaggagcagacagggcaccgcgagggtgctgggattataggtgtgagccatcgcacccggcccacacacacaccccccctttaatggtggagttgccaacagttgtccgatgtggcagagagaactggggagcagagaaggagcccatcactgggagggactgaaaaccagctcctgggcactgcagggcagagcgtgtgccggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 124194 - DNA, 811 bp, Homo sapiens
  Payload ID: 4387
  Gene Symbol: CYB561
  Gene Name: cytochrome b561
  ENST ID: ENST00000585153
  CDS Start-End: 1-220
ctaccgcccacagcacatcttctttggtgctaccatcttcctcctttccgtgggcaccgccctgctgggcctgaaggaggcactgctgttcaacctcggcttctcccttcctctcacccctgcaggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatg

SEQ ID NO: 124195 - DNA, 551 bp, Homo sapiens
  Payload ID: 4387
  Gene Symbol: CYB561
  Gene Name: cytochrome b561
  ENST ID: ENST00000578072
  CDS Start-End: 124-551
cagcccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggtgagttcccgggcgcggccttccccgccacctgcctgcctcttcaggcttggtggcggtgttcgactaccacaggaagaagggctacgctgacctgtacagcctacacagctggtgcgggatcctt

SEQ ID NO: 124196 - DNA, 877 bp, Homo sapiens
  Payload ID: 4387
  Gene Symbol: CYB561
  Gene Name: cytochrome b561
  ENST ID: ENST00000582997
  CDS Start-End: 13-789
agcgtctgtgggatgtccagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtgg

SEQ ID NO: 124197 - DNA, 897 bp, Homo sapiens
  Payload ID: 4387
  Gene Symbol: CYB561
  Gene Name: cytochrome b561
  ENST ID: ENST00000582297
  CDS Start-End: 64-696
gcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggc

SEQ ID NO: 124198 - DNA, 1193 bp, Homo sapiens
  Payload ID: 4387
  Gene Symbol: CYB561
  Gene Name: cytochrome b561
  ENST ID: ENST00000582034
  CDS Start-End: 87-755
agaaccggccaagcgacccgggcgcggcgcggggaggctgaagggacgctcgggtaggcaagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctga

SEQ ID NO: 124199 - DNA, 3061 bp, Homo sapiens
  Payload ID: 4388
  Gene Symbol: CYB561A3
  Gene Name: cytochrome b561 family, member A3
  Uniprot ID: Q8NBI2
  ENST ID: ENST00000294072
  CDS Start-End: 679-1407
ggctttctcttcccgctctatggccagtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaagctcgagtttcattaaatatgttaagaatcaaagctgtctttgttcaggctgctataacaaaaatataatagcctgggtggcttaaacaacaa

SEQ ID NO: 124200 - DNA, 1803 bp, Homo sapiens
  Payload ID: 4388
  Gene Symbol: CYB561A3
  Gene Name: cytochrome b561 family, member A3
  ENST ID: ENST00000447532
  CDS Start-End: 293-1084
tataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaa

SEQ ID NO: 124201 - DNA, 3205 bp, Homo sapiens
  Payload ID: 4388
  Gene Symbol: CYB561A3
  Gene Name: cytochrome b561 family, member A3
  Uniprot ID: Q8NBI2
  ENST ID: ENST00000426130
  CDS Start-End: 781-1560
tctatggccagtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggtgtggagtgtgggcagtggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaagctcgagtttcattaaatatgttaagaatcaaagctgtctttgttcaggctgctataacaaaaatataatagcctgggtggctt

SEQ ID NO: 124202 - DNA, 1094 bp, Homo sapiens
  Payload ID: 4388
  Gene Symbol: CYB561A3
  Gene Name: cytochrome b561 family, member A3
  Uniprot ID: Q8NBI2
  ENST ID: ENST00000536915
  CDS Start-End: 93-821
gttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctg

SEQ ID NO: 124203 - DNA, 573 bp, Homo sapiens
  Payload ID: 4388
  Gene Symbol: CYB561A3
  Gene Name: cytochrome b561 family, member A3
  ENST ID: ENST00000545361
  CDS Start-End: 408-573
gctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttagggggtgtggctacagatcctttcggactgcatttactttttcctcttacaaagaaaaaaaaaacagttgtggaagtagatattgtcagatgagtgagcctgctgatcaagatctcttacatttcactgagggatggagagtgttttaggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatgg

SEQ ID NO: 124204 - DNA, 4094 bp, Homo sapiens
  Payload ID: 4388
  Gene Symbol: CYB561A3
  Gene Name: cytochrome b561 family, member A3
  ENST ID: ENST00000537364
  CDS Start-End: 3548-4094
agggagtggacccgaattcctgtaccagctcggccacttaccttggctaagtcattttcttgttttgggccccagtgtcacagtgtttttgatttgtaagatgagggtttagggcttgtatcctaaatctggtcctcaagattcttgaagtcccccagtccatcggggagggagagcaacaaactgattttctaccccttcatttatttgtagttctaaattataaaagtaacactgcaagagtttggagtagagcctttttctttttctttcttttttttttttctgagacagagtctcactctgtcgcccaggctggaatgcagtggcacgatctcggctcactgcaacctccgcctcccgggttcaagcgattcccctgcctcagcctcccaagtagctgggattacaggcgcccgctaccgcgcccggctaatttttgtatttttagtagagacggggtttctccatgttggtcaggctggtctcgaactcctgacctcatgtgatccgcccgcctcggcttcccaaagtgctgggattacaggcgtgagctaccgcgcccagcctgcgtagagcctttttctaagactaagggctggatgggaactagcatttcttacccctggatgtgacctgttttagctcagccgggagaatcctttttcgcaagaagttaataatatcttgtgacgtgaaaattatgtgaaactcagacttcagtgtccataaataaatattactggaacacagccgtggtgctcatttgttaagatgtttatgtggctgctcttgcatgggcagagttgatgacatagttgtgacagaccatgtgctctacaaagcctagaatatttactacctggacctttacagaagagcttgctgactgctcccttagaatggggctctgcaaagtgagcacaccctgggatcacagcccagcctgcccttagaacaaatgagaggatattttcaagcatttgcattgcagttttcacggtttttttgttttgttttgtttttgagacagagtctagctctgtcgcccaggctagagtgcagtggtgcgatctcggctcacttcagccttctcctgggctcaagccatcctcccacctcagcctcctgagtagctgagactacaggtggatgccatcacgcccagctaatttttttttttttttaagagatgagggctcactgttgctcaggctggtctggaactcctgggtatttatttatagacagagtctatctctgttgcacaggctgcagtgcagtggcgtgatcttggctcactgcaacctctgcctcctgggttcaagcaattctcgtgcctcagcttcccgagtaccttggactacaagcgcatgccaccgtgcctggctaatttttgtatttttagtagagacgggattttgccatgttggccaggctggtctcgaacccctgacttcaggtaacccacctgcctgggcctcccaaagtgctgggattacaggcatgaatcactgtgctggtccttcactgcattcttccttttctcctgctttgctctatttcaggaagtaggagggcttatctgtgtattgtgagcagggcaatataactttgcagctctctgtcaggaaagtgtgcccagggtctattctaagtctgtcacagagcagtaaaccaggaccttttctagggtgtggctacagatcctttcggactgcatttactttttcctcttacaaagaaaaaaaaaacagttgtggaagtagatattgtcagatgagtgagcctgctgatcaagatctcttacatttcactgagggatggagagtgttttaggtgaatatctggtgatctgaaacgtcctctgcccttggaggaattgaggaggcagttctgaggctgggtagcaaatctctgagttaagtagttgagtcacaaatcttctaggaggctggtggcatgattttctcctgccagcttcatggaagctttttccctgcagcccttggaccttcttttcttttttttttttttttttgagacagagtctcactctgtcccccaggctggagagcagtggcgcgatctcggctcactgcaacgtccacctccagggttcaagcaattctcctgcctcagcctccctggtagctggaattacaggcgtgcgccaccacacccagcacatttttgcattttcagtagagacgtggtttcaccatgttggccaggctggtctcaaactcctgacctcaggtgatccatccgcgtcggcctcccaaagtgctgggattacaggcttgagccaccgagcctggctggaccttcctttctcagagattactgccaacttgggtcaccttgtgcatctttacctaagtaggtggacccctagcatggggagagctggcatggcatggctgagggccactgagaggcctgggcaggcacaaggaacatgagctgcatgttagtagttaggatgaagtgcatgacagcaatgactaagaattctatgtatatatatatatttttagatggagtctcgctcagtcgccaggctggagtgcagtggcgtgatcgcagctcactgcaacctccacctcccgggttcaagcgattttcctgcctcagcctaccgagtagctagctgggactaaaggcgcgcgccaccatgcccagctaattttttatttttagtagagatgggggcgggggttcaccatattggccaggatggtctcgatctcttgaccttatgatctgcccgcctcggcctcccaaagtgctaggattacaggtgtgagccacctcacccagcctttttttttttttttttttgagatgaagtttcgctctcattgctcagggtggagtgcaatggcacaatcttggctcattgcaacctctgcctccctggttcaagcaattctcctgcctcagcctcctgagtagctgggattgattacaggcgcccaccaccactcctggctaattttgtatttttagtagagaccggggtttcaccatgttgatcagtctggtctcgaactcctgacctcaggtgatccacctgcctcagcctcccaaagtgcaggattacaggcataagccatcgcgcccagcgaagaattctaatacttgacttctacagtgtgctacattcattttctcacttgatctgacaacctgtggtcaaggaagcagcgtgggccttgaagctaaacacacaggatttggaactccccacccactctcactgggtcctcatgctaattacttatctctctcagccttagtttcctcacggaataatatgcctcccagggttaagaggagtaaatgggatcttgtgtgtaaggctctggtgctcgtagctggtgttcgttattcttactgttcaagtattcttactgccacgcctttcttgcaggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtt

SEQ ID NO: 124205 - DNA, 540 bp, Homo sapiens
  Payload ID: 4388
  Gene Symbol: CYB561A3
  Gene Name: cytochrome b561 family, member A3
  ENST ID: ENST00000537680
  CDS Start-End: 455-540
atgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgca

SEQ ID NO: 124206 - DNA, 1202 bp, Homo sapiens
  Payload ID: 4388
  Gene Symbol: CYB561A3
  Gene Name: cytochrome b561 family, member A3
  ENST ID: ENST00000540139
  CDS Start-End: 830-1202
atgatgctttttagcctagaaactgcaaacaagctgaatttattattgtgaaaatagaatgagaggtccaagaaacctgcttcccccctccactttttttttaggagacaggtttccctctttttcaggctagagtgcagtgggatgatcatagcttgctgcagccttgaactcttaggctcaagtgatcctcccacctcagtcccccaagtagctgagagaacaggcatgtgccaccatgcccggataatattttttatttttattttttgtggacacaggatcttgctatgttgcccaggctgatcttgaacttctggcctcccaaagtgctgacatgagtcaccgtgcccagccctcctccctttttaattggaatctgtttatttatttatttctctctgtggcccaggctagattgcagtggcatgatcatagctcactgtaacctcaaactcctggcctcaagcagtcctcccaccttggcctcccaaaaagtgctggaattacaggcatgagccaccttgcctgaccactcctccctttttaactggcccttctctcctcccttcatggctgttatcccacaaatcatgggagggtagaagatgccgaggagttgataccagtgccctagcatttcctgttcccttgctgggaagctgtgtaggatcctatcagggttattccctgatgtctgggtgagctcgaggggagaggctgagccctggcactactctctcctgcagcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgc

SEQ ID NO: 124207 - DNA, 3986 bp, Homo sapiens
  Payload ID: 4388
  Gene Symbol: CYB561A3
  Gene Name: cytochrome b561 family, member A3
  ENST ID: ENST00000546151
  CDS Start-End: 270-557
gccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgtgagtgcagtggggtccccaactctaaggtgaagaggagggaatagggtcttcaaaagatacaccctgtgatcacaggactcacccaagggaggagagattttggggttgggtccactcctgatctggaaggtaacagaattgatctttctttaggttgaaattggtaagtcagcagatatttattgagcatcagtttgatttagcacctgctgtgtgtcagaaacagtactaagcaccttacatttaatcctgtcaaccaccctacatcattggtattgattggtattgttgtcattgccattttcttttttctttttttttgagatggagtctcactctgtcgcccaggctggagtgtagtggcacaatcttggctcgctgcaacctccacctgctgggttcaagcaattctcctgcctctgcctcccaagtagctgggcctacaagtgtgtgccaccatgcccggctaattttttgaatttttagtagggacggggtttcaccatgctgggcaggctggtctcggactcctgacctcatgatctgcccgcctcggcctcccagagtgctgggattacaggcatgagccactgcacccggccgtcattgccattttcaattgagggaacagattctgcaataggactgttcaggtagaaataaaaataaaaaaaatgagggaacagaggggttacgtaacttacccgagggcacacagccagtaagtggcagagctgggactcagattaggcagtctgactctagagccttgcatgcctgaccactactgtccgttcttttgaggcaatggggtgtagtgaaaagcaactaggacttaaggtcagaccttggtttcgatcttggctgtgccatttactagttatgcaactttgggcaagttaatttcattgctttgagcttcagtttcctcatgggtaaaaggattattacagctgggtgccgtggcatgcacctgtagtcccagctactagggaggctgaggtggaaggagtccagcctgggcaacataggaagaccctctctctctccttttatccccccagccaagagatagcatctcactctgttgcctaggttggagagcaatggtgtgaccatagctcactgcagcatcaaactcctgcactcaagcgatcttcccaatgtagcctcctaagtaagctaggactacaggcatggaccacctcacctagctaagttttatttttgtagagacaggatctcactatgttgcacaggctagtctccaactcctggggtaaagcaatcctcatgccttggcctcccaaagtgctgggattacaagagtgagccgctgcacctggctcattatacaaatatttgcagggacttagaaagggtgttaaaattcagccgggcgcagtggctcacgcctgtaatcccagcactttgggaggccgaggcgggcggatcatgaggtcaggagatcgagaccatcctggctaacatggtgaaaccctgtctctactaaaaatacaaaaaattagccaggcgtggtggcaggcacctgcagtcccagctacttgggaggctgaggcaggagaatggcgtgaacccaggaggcggagcttgcagtgagccgagatcgtgccactgcactccagcccgggtgacagagcaagactctgcctcaaaaaaaaaaaaaaaaaaaaaaagaaagggtgttaaaattctagatcacatatggacccgggaaggttttctcaccctctgttagtgacatcgagtctcccactagacaaaaataggtggaaaaatctctcgagggctcacattgttttgtcatcttcaggaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacaggtatgggttccagtcccacattccagggtgggacagggccaggtctagagaaggatctcccacgaaaggctggggccttgacaagaagacttaccctgtggcacagcaggaaaccaagtaacttgagggtggagttagggtggctgatggggagcactggtcccaaaccagcgcatcccagtgaaatgctgggactccccagtctgtccattgggagacagaatttcccccccaaatcactgtggttctgtggggtgaagtgtggccttatcttcttccccaaggaagggcttgactgtgacaagggtgtgtgatttctcctttaccagcctgggggctagtctagtgggatgggtgcctggtgaccagctgagtgctcagagcaggtcttgatgggatgtagggagacggggtgtgtaccaggctcagggactttggggcttccctgagggatttggtggcttggatggggaccaccctgcaggctgggggtctgtctgaacagcttgggcctggtgtgactcctgcatcatgtcattaactcctgggcatctgcctctctttccagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttc

SEQ ID NO: 124208 - DNA, 779 bp, Homo sapiens
  Payload ID: 4388
  Gene Symbol: CYB561A3
  Gene Name: cytochrome b561 family, member A3
  ENST ID: ENST00000539128
  CDS Start-End: 434-779
tctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaagaggaagagaaagcagaagtctcagggctggagacagctgaggggcatcagctggttcaaggtgtggagtgtgggcagtggagtgaaggcctggttacctctccagtgaagattagccccatagagcttactctatggggaagaacttttctgactccttcctgtctagggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactccc

SEQ ID NO: 124209 - DNA, 650 bp, Homo sapiens
  Payload ID: 4388
  Gene Symbol: CYB561A3
  Gene Name: cytochrome b561 family, member A3
  ENST ID: ENST00000542361
  CDS Start-End: 52-650
ggctggagacagctgaggggcatcagctggttcaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgc

SEQ ID NO: 124210 - DNA, 572 bp, Homo sapiens
  Payload ID: 4388
  Gene Symbol: CYB561A3
  Gene Name: cytochrome b561 family, member A3
  ENST ID: ENST00000539890
  CDS Start-End: 89-418
agtgttacctcctttagccagagaactgggtgcatctgagccagtggagatttgtgacttctccttcttctaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtggaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggc

SEQ ID NO: 124211 - DNA, 1494 bp, Homo sapiens
  Payload ID: 4388
  Gene Symbol: CYB561A3
  Gene Name: cytochrome b561 family, member A3
  ENST ID: ENST00000540755
  CDS Start-End: 233-550
aggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggct

SEQ ID NO: 124212 - DNA, 1136 bp, Homo sapiens
  Payload ID: 4388
  Gene Symbol: CYB561A3
  Gene Name: cytochrome b561 family, member A3
  ENST ID: ENST00000544118
  CDS Start-End: 229-543
attcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccaca

SEQ ID NO: 124213 - DNA, 5009 bp, Homo sapiens
  Payload ID: 4389
  Gene Symbol: CYB561D1
  Gene Name: cytochrome b561 family, member D1
  Uniprot ID: Q8N8Q1
  ENST ID: ENST00000310611
  CDS Start-End: 42-443
tgttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgaggtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgcctttttttaaaaaaaaaaaaaaagccagggcagggtgcttagattttaaaaatttgcgtgtcatttgcacaaattttcatatcaagctaagtcctgattccaaatttgattatattccaaatttgattatattccaaatttgattatattcagattcaaccttgaggacattagaaatatagatggcttctgtatccaaatctgaatggaaatgagattacccttctgggttcagatacccctcccaagcccccgtcttttctgtaaccacccctcctctgagccccatcatggctggggttggtatggaatgggagcagctctgtatctggggaagtcctccagcctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccaggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtgg

SEQ ID NO: 124214 - DNA, 1085 bp, Homo sapiens
  Payload ID: 4389
  Gene Symbol: CYB561D1
  Gene Name: cytochrome b561 family, member D1
  Uniprot ID: Q8N8Q1
  ENST ID: ENST00000369868
  CDS Start-End: 27-782
agtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatg

SEQ ID NO: 124215 - DNA, 620 bp, Homo sapiens
  Payload ID: 4389
  Gene Symbol: CYB561D1
  Gene Name: cytochrome b561 family, member D1
  Uniprot ID: Q8N8Q1
  ENST ID: ENST00000393709
  CDS Start-End: 89-607
ctctcctgcagccgccaccgcctccgcgatcgcaaacccggaagacgtgttcgggcagctggagtgtacgggcccgcgggccacggccatgcagcccctggagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacg

SEQ ID NO: 124216 - DNA, 3326 bp, Homo sapiens
  Payload ID: 4389
  Gene Symbol: CYB561D1
  Gene Name: cytochrome b561 family, member D1
  Uniprot ID: Q8N8Q1
  ENST ID: ENST00000420578
  CDS Start-End: 41-730
gttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccagtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgccttttttt

SEQ ID NO: 124217 - DNA, 5077 bp, Homo sapiens
  Payload ID: 4389
  Gene Symbol: CYB561D1
  Gene Name: cytochrome b561 family, member D1
  Uniprot ID: Q8N8Q1
  ENST ID: ENST00000430195
  CDS Start-End: 26-412
gtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccaaaacaggtcccctgatggaggatagaagtgaaggaggccgggcgcggtgggtcatgcctgaaatcccagcactttgggaggccgacgcgggtggatcacttgaggtcttttctcctggcaccctgtattcatggccttggcggatgtatgagagcacctcctttttctcaggcctccaagccagacatgaggcttactggctctctcctatgttcacagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgcctttttttaaaaaaaaaaaaaaagccagggcagggtgcttagattttaaaaatttgcgtgtcatttgcacaaattttcatatcaagctaagtcctgattccaaatttgattatattccaaatttgattatattccaaatttgattatattcagattcaaccttgaggacattagaaatatagatggcttctgtatccaaatctgaatggaaatgagattacccttctgggttcagatacccctcccaagcccccgtcttttctgtaaccacccctcctctgagccccatcatggctggggttggtatggaatgggagcagctctgtatctggggaagtcctccagcctcaccttcttggctcttaagtggtaggctgttaccacttgccagcctgggcctcctctctccccaccctttcacaaggcaggctgcccttccgcactcactggcccatcccttctttctcatcgtcccacccttccacccccgtgcatggctgctgtaggtctggtttttttggtttttgttttttttaagacggagtctcactctgccgccaggctggagtgcagtggcagaatcttggctcactgcaacctctgcctcccaggttcaagcgattctcctgcctcagcctcccgagtagctgggactacaggcacgtgccaccatatccagctaatttttgtatttttagtagagatggggtttcaccatgttggccaggatctcttgacctcgtgatctgcccgcctcggcctcccaaagtgctgtgattacaggcgtgagccaccgtgcctagccaggtcttgttttgaaaacctcactgtgggagattcaggcatcctccctaagccagctggccgctgtgctaaagcctgttcagagttaataataatcattagctgaatggtgctggggcctttcagcttcagatctctaagcacttgcaggctgagtcagtcagccctcaccttccccctccttcctgggctgcagagtgtaacagaatgggaaggcactgtgggaaggaagtcaggaatcttgctgctagccacgccttgcagtgacttctcgtctgggagtgggcactgagtcctctcagtaaactaataagacttgcacctgacaaaggtcaagatatgtagggaacacagtgtatgctaggctgagacctatggtggtggcaggggtggctgttgagcctgaacttccagtactcctgcccttccttctgtttacctggcttggcctacagggggcacccctggtcttgatgcctcaagcccagcatttctgggtcccctctgcaagctcagagagcagggaggcttctggtagtgctcttgatgctcctgtgtctggttggcacaaagatcctgtgtaacatgaaatgaaaggtgcatcagcttgggggctgggaaacctgcagtatgggtttactccgtccctatcactggtgtggctgtgggcaaaccacttattgcctgacctacctcacagggatgttgtgagggtttgatgagagaatgaatgttaataggaattggaaaattcaaagcattaaacacatgtaaacaggtggtattatt

SEQ ID NO: 124218 - DNA, 892 bp, Homo sapiens
  Payload ID: 4389
  Gene Symbol: CYB561D1
  Gene Name: cytochrome b561 family, member D1
  ENST ID: ENST00000527072
  CDS Start-End: 41-208
gttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccattctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaa

SEQ ID NO: 124219 - DNA, 1271 bp, Homo sapiens
  Payload ID: 4389
  Gene Symbol: CYB561D1
  Gene Name: cytochrome b561 family, member D1
  ENST ID: ENST00000528785
  CDS Start-End: 36-731
ggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccagtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaattgctacctaagaggagccagggtaagtgctgcaaggcatggcagacaaaattgcacatcttggccagaatctaaggaacttcttgtggtttgggggaggtggtgaggatgtgggtggtgggtgggtggggggtgttgaagagatgcagccatggacttccttgggcttggcacaggccaaaacagaagagagaactccaaactccaagtagtcctcatcagacttgctctccttatcagcttcatcctgtcagccaaattgtcagccatagaaaaactgctttgcagatgaaaaactatataaatgcagagtatgggagtgctctgacatcaacagctgtcatttcactgactgccaaggttgacttgtctgatgtggctggttgtgcagtagctccacccctcgtcaccttggttgttcctcctgaagtgaaaaacaactttccaaatagaggagggctgcccttcggtcaagactttaggtaagtattcaaattcgcattcttttaatttttttcctggtatcatttcctctccctctttggaatctg

SEQ ID NO: 124220 - DNA, 913 bp, Homo sapiens
  Payload ID: 4389
  Gene Symbol: CYB561D1
  Gene Name: cytochrome b561 family, member D1
  ENST ID: ENST00000533024
  CDS Start-End: 61-225
atcgcaaacccggaagacgtgttcgggcagctggagtgtacgggcccgcgggccacggccatgcagcccctggaggtcttttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtg

SEQ ID NO: 124221 - DNA, 3424 bp, Homo sapiens
  Payload ID: 4389
  Gene Symbol: CYB561D1
  Gene Name: cytochrome b561 family, member D1
  ENST ID: ENST00000496961
  CDS Start-End: 62-256
gatcgcaaacccggaagacgtgttcgggcagctggagtgtacgggcccgcgggccacggccatgcagcccctggaggtaggtctggttcccgctccagctggggagccgagactgacccgctggctgcggagaggcagtgggatcttggcgcacctggtagctttgggcttcaccatctttctgacagcgctgtcccggccaggaaccagtcttttctcctggcaccctgtattcatggccttggcggatgtatgagagcacctcctttttctcaggcctccaagccagacatgaggcttactggctctctcctatgttcacagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatgtgagttcctgcgaacgctgaatctaggtgggacgcttgccttgaacatcatggttcctttggtgatctataagggatctatttaagaagtggtcaggttttcgcacttcttggctggtccagggactgcagaaaccaaagctgctattgttgaggaataattcagtgggtcaaaatggggagatgtactgggtatgagtggaaggtgatggagagcctgatcctgaagcctctacttgatgagagacagagttttgggtggtgatagtgatgtgctggtggtcatttcttgcttgtgtgcctgatgaaaaactgggttcctgtaagttatgaatggcatccagggatatttgggttacttttaagaaagcagtgtgatgtagtggagagagcccatgggtcttatttatgggatatggtcctcttaggctctgttgtacaaccttaggtacattccatatcttaagaccactgtttcttcatctgtgaaatgtttctaaacaatctctaagtcccttccttctctaatatacagcgtctgtcaggtcgatgtctcagaacactctcccagctgtggaccacgtggaccacttagcagactcagggggtagttctttactctccctttactaccctggagggacagctctgcccttgaggcccttcagaaatttgtgctgatttggtccctgtgccagggcacagggggtcaggcactgtggaaagaagggactcaggtgagggtcttctggactctaagacggtaaaggcactaaagtcactttaaagcttttggagaagcaggagggcattggcttaaccaagccgaaggctgctggctgggctgcctagcccagctaagatcttccttcagcccacctcaggatccgggcttgagggctgcagggcctgcgtgcgctccctcccccgaaatcacttctcagggcaaaggagccccaggcatctcatgctttgcccttcttagggctcaggttcttgccttagcacatagcttctgggagcttttttgaagcatttcataagggccaaggaagtggggcagggcttttctgatccaaagaaaacaaagtttctctggttacccctcttcccttgttatctaagctttcctcagttgtcatctcttcccagctctttggtccaagagggggctgagtttggtgccagctggcaaatgagggctggactctcttccctccagagaccaccccgctccttgctgcagctgaaagtagttccccaggctgccctcggtggtgaggactggatgctagactgctgagctgtggtctgggctcagttgagaagataggatctccctagatcatggcaaggcctgacaacagctgagccaggaaagtgctgctgaggcaagtcgacatagctcacagggaactctgggaagcctgggatgtaggcgctggagctccagttcccaggagcaggggcaggtgttcctagatgttagtgttgtggatgtccttggtcttctgaagattcaggtcctcctctccgggtagcttagaagtaaggaggttggtttgattcaatagtatggggacagaatggggacagcaagggcagaagtgtcctctccacgtaactcattatgcccctcctgggggagattgcatctccaggacaagcatctaaaggaggcccctgctgtgcagaggggtattgttcctgtctctttcattgtcctccctcctctcaaactctccagtgtggtgtgaactcagaagaaacggttactggggctgcatggagaatttcacctgcggtgattttgatccagggactgcatctcctctttcctcatcacagccagtgctgagaggctccttctacctgccgcagggtaggagggccaggcaaagttcaccagcttgctctaagagcaagcaggcaatgccgtaaagcctgagcctgcctgaggtgctgcctcctcccaggtggtgcgggggctggtgggcgggcgggcaggcgtgctgacagccggcagtttgcgtgggctgtgccatctgatgtctattcccagccctgggaggaagggggagtcatttatattctgcaggaggaaggggccccagctgtcgcctttctgaccagcaggcctggagggcaggggcacagagcagagaggagggcactggtggtctcctgcttagcctggtctgactgcagtgtagggaataggtcaccaggaggagcccttcatcctggcaggccggattgtggagggacttccctccccctcttttccatttctccctccatcaccacctgccctcacatcctggggcagcagctggacagccattagacctcagtgccagggcactcttcctccagctgggatctcagtggctcccagctgcatgggctcctgcttgtgtgttccctcctccgccatcctctgttccccgcacctcccttattctgctcatgtctggggtattcacttggctcctcagcaaggaagcaaacgccttggaggagaagcacatggttgcccttttgtccttgctccctggctagggaaagctgctagtggtcagcctgttttgccttttttt

SEQ ID NO: 124222 - DNA, 1225 bp, Homo sapiens
  Payload ID: 4390
  Gene Symbol: CYB561D2
  Gene Name: cytochrome b561 family, member D2
  Uniprot ID: O14569
  ENST ID: ENST00000232508
  CDS Start-End: 232-900
ggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 124223 - DNA, 1533 bp, Homo sapiens
  Payload ID: 4390
  Gene Symbol: CYB561D2
  Gene Name: cytochrome b561 family, member D2
  Uniprot ID: O14569
  ENST ID: ENST00000418577
  CDS Start-End: 577-1245
gggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaa

SEQ ID NO: 124224 - DNA, 1319 bp, Homo sapiens
  Payload ID: 4390
  Gene Symbol: CYB561D2
  Gene Name: cytochrome b561 family, member D2
  Uniprot ID: O14569
  ENST ID: ENST00000425346
  CDS Start-End: 316-984
cagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaatgactgaaaa

SEQ ID NO: 124225 - DNA, 1212 bp, Homo sapiens
  Payload ID: 4390
  Gene Symbol: CYB561D2
  Gene Name: cytochrome b561 family, member D2
  Uniprot ID: O14569
  ENST ID: ENST00000424512
  CDS Start-End: 236-904
ggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaaccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagt

SEQ ID NO: 124226 - DNA, 927 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000223336
  CDS Start-End: 152-592
aagtctctactgctccccgctggcgcgcaggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatctttgctagttctc

SEQ ID NO: 124227 - DNA, 1085 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000310564
  CDS Start-End: 320-760
tttcccaagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggtttgcctttccccacggacactctggaccttgtagctcctcaagcttccctgtctattgagcagataggaagccgtgtcaaatatgtggcaccttgaggaaatgcctagtgaatgacagacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 124228 - DNA, 2448 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000395879
  CDS Start-End: 1683-2123
acccttttgcggcacacttgctaccttggtcttagctctgggctttggtgtcctctggcagtcctgctgcattgccttctctcccccatctgcccacccctgtcccagagagatttttctgtagcccctcatctgcagagtccgacagctcagggtcgagggtctttcttagcagtaatcacccactatgctctcacccctccatttctggacatgcttcctgtggcttctctcctgcgctttacacttcagcagttcttgtttctgctcactctgcctttgtttgtcatttcctggatttgaagctgttctgctcttttcacctttctcttctcaaggtaaacttcctctgtgaaacctccgctgatgccctgcagcaaggttgaccacttcctgagtgttacttcctctcttggtgcatatgtctggttgcactaaccaggctgctgctagcccaaaggcacctttgtgcaaattagaaaaagacaaccatccccatcccttcttcaagatactttatagtacttccaactgttggcaaactgtcttaataaagatacaaatctttgatttctctaatgtgcatggtgccctacaagggttgtgcagtgcatagccgtgcagttgcatgtgatagatctatgttataattatttgtttaattgtctgtattcccctcaggaccaaggaaaattccttatatcttgatactgtttttatattcttactgtctgaccagatcagaccctcagtaaccgtttgctaaacaaaagaaggaatgaaggtacaaatatgtatccaccttgtctggaaaaatagcaggaaaggcatgcctgccaaggacttttacactgaacagtaagaatatattttagctcagagacactgtttgttttcacatttcaatattgctttaattagatatcttaaagctcgtgtaccacagtggttgaaagagcagatgctggagccagactgcatgaatttgaatcccagttctaccacttattcacttattagtgcacctttgggcatgttacttaacctttctgtgcctcagtttactcatctgcaaaatgagcgtgatgataatagttcctacttcaaagggttgtgagaattaaatgaattatataaagtgcttagaatagtacaagacacataatagtcagagacagaagtattaggtattatcaatattgttaaagtccatgtataagtttactgtactattgtttctttttaactctgaagtgctgttttcactctgtcacgtacagcttttattgctagcatcttgcttctgcaggtccagcctcctgttgattggccctgtgtttgtgctgtggtcaaagcacttgctgtctgcggttctcccttgtgcacaccggttctttggttgctgtaacaaaaactacataggacacagacaggaaacccgcaggctttgttttttcttcctaatttggcagcagaagggggaaaaaccagggcctttcacagacaaggcttgttttagagtttaattttaacttcttgttcgtgttctaaagcttgggttggtaataaatcttggctgtatgagactagagagaactgggctttaaaaatatgattttaatgtaaaatcttttctaattgcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggtatgtgccagcacatggtaattttggtgtaattctaacttgggcacaacaaatgctatttgtcatttttaaactgaatccgaaagaaactcctattataaatttaagataatgtaatgtatttgaaagtgctttgtataaaaaagcacatgataaaaggaatcagaattaataaaatgtttgttgatcttt

SEQ ID NO: 124229 - DNA, 406 bp, Homo sapiens
  Payload ID: 4391
  Gene Symbol: COA1
  Gene Name: cytochrome c oxidase assembly factor 1 homolog
  ENST ID: ENST00000457939
  CDS Start-End: 108-299
acccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaagtaagtatcctgctagccgcctgcggcctgacctcctcctagcctgctcctgctcctccatcagaggaaatacttgagatgctttgtttagattagagaaaggaggagagggtgattttaaaggctagtccaccatttcgttggctatagcttcctctgtatcctgtaatctcagtttttccag

SEQ ID NO: 124230 - DNA, 3223 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000438444
  CDS Start-End: 393-833
cgaaacccttcccggcgcgagtccgagcgtctgagaagcagaagccacacgtcccggcgacctaagttctggatcagccggccggaggacccgtgttagcatttacaatccgaggtgagctgaagcctccggttgtcccggttcgacgctctagccctgcgagcagccgacgccggaagtctctactgctccccgctggcgcgcaggaccgcgggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatggcctccctattccctgagacacaacagtattgaaattgggccaattaataaccccacagtggcctctcactaaatgtgagaggtgaggaagctgcaggagaaaatttgaagctagcagtgttcatgagatgtaagtaaagaagccatctccataaaagtacaacgtgacgcagcaagtgctgatggagaagctgtagaagttacacagaagatctagcttggaccatcgatgaaagtggctacactaaacaacagattttaaatgtagataaaacagcattttattggaaaaagatgccatctaggactttcatagttagaaaaactcaatgcctggcttcaaaggacaagctgactcttgtcaggggctagtgcagctgtgactttcagttaaagccaatgctcattgactattctgaaaatcccagggcccttaagatatgctgtataaacgcaacaacaaagcctggatgacgttgggtctgtttacagcctggtctactgagtaagcccactgttgagacctagtgctcagaaaaaatagatttctttcaaaatatggctgggtgcagtggctcacaccggtaatcccagcactttgggaggctggggcgggtggattgcttgatgccaggagttcaagaccagcctgggcaacatggtgaaaccctgtctcaaaaaacaaatccaaaaaaccaaaatattgctactcattaacaatgcacctggttacccaagagctctgatggagatgtacaaggagatgaatactgttttcatgcctgctaacacagtatccattctgctgctgatagatcaagaagtacttttgactttcaaaacttgttatttaagaaatacattttgtggtttctctgatggttctgggcagtcagttcaaaaccttctggaaaggattcaccattctagatgccatcaagagcattcaattcacgggaggaggtcaaaatatcaacattaattggaatttggaagaaatagattccaatcctcatggaggacttggagggtttcaagacttcagaggaggaaggaactgtagatgggctgaaaatagcaagagaactagaagtggaggggcctagagatgtgaccgaattgctgtaacctcaggatcaaacttgtatggatgagaagttccttctcatggacgagcaaagaaggtgatttcttgaaatggaatctactcctggtgaagatgctatgaacattgttgaaatgacaaaagatttagaatattccataaacttagctgtggccagggtttgagaggattgactcctaattttgaagttctactgtgggtaaatgctgtcaaacagcattgcatgccacagaggaatctctcatgaaagagttaataaatgcagcaaacttcactgttgtcttactttaagaaactgccacagtcactgcaggcttcagcaacttatcttttcctaccctcctctcgcatttaaaagtacttttaaattaatgtatgtacattatttttaggcataacactgctgctcatttaaaaaaactacagtatgaaccatgttatatgcagtggaaaggcaaaaaattcatgtgacttacttgcttgtatttggtttattgcagtggtctggaactgaaagtgatgcgtatttctgagttatgcctgtatttaagaagctgagtgaaacccaaagaagtccatgataggacagacttctgaaaactaaagacagaaaaaagcttgaaagcatcaagaaagaagtgaaatcttagctagagggaaaagtaactcagatgacagtggatttctctctggaaaccatggaggccagaaggaagtgagacaagttcttttagtgccagaagaactatcaacttgtggctgggcacggtggctcacacctgtaatcccagcactttgggagaccaaggtgggcagatcacttgaagtcaggagtttgagaccagcctggccaacatggcaaaaccctgtctctactaaaaatacaaaaattagccaggcatggtggcacatgcctgtaatctcagctacttgggaggctgaggcacgagaattacttgaacccgggaggtggaggttgcagtgagccaagatcctgccactgcactccagcctgggcaacagagcaagactgcctcaaaacaaaactctgtcaactccaaattcctatttggtgaaatgatccttcaggattgatggggtaataaaaacattctcggttgatagaaaact

SEQ ID NO: 124231 - DNA, 547 bp, Homo sapiens
  Payload ID: 4391
  Gene Symbol: COA1
  Gene Name: cytochrome c oxidase assembly factor 1 homolog
  ENST ID: ENST00000420441
  CDS Start-End: 121-225
accgcgggcatttacccgtgctttcccaagcctggaagaactcgtcatgctctttgtagcgtggtgcttctgttgctcacaggacaacttgcctttgatgattttcaagagagttgtgctatgatgtggcaaaaggtaatggaatgttccagggccaagttccccactagaacctgccagggtattctcgagttagacaatagaagaaagtcactccctgaatagttatgggcttctcctggtctttagggttcacttgtgctttaacttcacaggagggatgggcattttctgcattgtttcccactctgtctttctctcgtgtctcatgctggcgttggaagctgtaacactctgggaacctctccataacccagtctggctgcctcaccctgttgagctctcttcaaattaagcaagatctgactaatacattcttcagagatgctctgaccgttttcattatgagaactaaatgacttttcccagatcacattactgtaattaactttacactcattttgatactcttacatattataagagt

SEQ ID NO: 124232 - DNA, 1599 bp, Homo sapiens
  Payload ID: 4391
  Gene Symbol: COA1
  Gene Name: cytochrome c oxidase assembly factor 1 homolog
  ENST ID: ENST00000448704
  CDS Start-End: 213-317
atttacccgtgctttcccaagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaaggtaatggaatgttccagggccaagttccccactagaacctgccagggtattctcgagttagacaatagaagaaagtcactccctgaatagttatgggcttctcctggtctttagggttcacttgtgctttaacttcacaggagggatgggcattttctgcattgtttcccactctgtctttctctcgtgtctcatgctggcgttggaagctgtaacactctgggaacctctccataacccagtctggctgcctcaccctgttgagctctcttcaaattaagcaagatctgactaatacattcttcagagatgctctgaccgttttcattatgagaactaaatgacttttcccagatcacattactgtaattaactttacactcattttgatactcttacatattataagagtggatggatggtatgctgtatttaccgagctggcatccctccatctgttcattcagcctgagtcataaccagagtttcctcatcccaagggtggtgcatttttcaaaatatgaaaggagccagtgacagctccagcccattcgcaggcttacaggaccagccattgccacaaaggataagcttcctgtttaccagttggcctgagacaaagtggttgtgcttcctggccatgcggggcttggcacacagtctgggctgtgtctgtcaggatggtgggctgaatgctcgctctgtgctgggctggctgggggtggcagggcccccacagcatgggtcctggacatgggccactctcgagagggcaccctcaggagggcactcagtttggcttcagaaccaaccctggcatttggaaaggaagcaaatgagggagggcggtctggcctcctttctggcttccttaatgcttctttcctttaggggtccaagccgggcaaatccccttggcacaaaactgggaatcctacaataaatttgtatcttttgtttttaagtatgcaggaagcaggcggtcaatgcctctgggagcaaggatccttttccacggtgtgttctatgccgggggctttgccattgtgtattacctcattcaaagtaagtatcctgctagccgcctgcggcctgacctcctcctagcctgctcctgctcctccatcagaggaaatacttgagatgctttgtttagattagagaaaggaggagagggtgattttaaaggctagtccaccatttcgttggctatagcttcctctgtatcctgtaatctcagtttttccaggagcaacgagtacaaataaaaggaccaggactaatatgcataagaagcccagcaaagcacgatgggctttcagtccagtgcacacacaggggctccatcaagattctgagattatataaagaa

SEQ ID NO: 124233 - DNA, 1737 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000415076
  CDS Start-End: 124-564
aggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtactagcaacagtttttgaaccctgaatactgtcataactgaagctagaattatccctggacttgtttgccactaaaatttccttgttttgcttaccctggtttcagctggcaccctgatcacttgaaaggaacataactgatatactgtcctttgtttttctttccttcctcttctccgcctttgatgattttaaattagaaatctacctgcctctaatctctttaattttctcatttatttactgctgcctattttccaaaacactgcttctcgaatattcctggctcaaaaatcatctatgtcttcatgacatatgaaacccctagaatccagcctttccccagcttttaatatctcctaattgatttctcaattccagtgaaatgattccatttatttttttcccaaacacatcacaaatattcctaactcttgtgagcaattttctctcattcttctcaacttatctaaatcctaacttttcaaaagatctagctcaagttctgtcttatcatattttgagttcctttctttggcattgtattattttgtatctttccatgtacacatgtgtgcattatctccctgataaaactaactggctagaggataggagtaaagactcaattctaatatccttgttacctaataatacacaaacgtgaaacatgtttgaataaatcactgttaaatat

SEQ ID NO: 124234 - DNA, 524 bp, Homo sapiens
  Payload ID: 4391
  Gene Symbol: COA1
  Gene Name: cytochrome c oxidase assembly factor 1 homolog
  ENST ID: ENST00000415798
  CDS Start-End: 184-524
gctggcgcgcaggaccgcgggcatttacccgtgctttcccaagcctggaagaactcgtcatgctctttgtagcgtggtgcttctgttgctcacagagtctcgctctggccagagattttctaaataatggtcaggaatctgcattgacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagag

SEQ ID NO: 124235 - DNA, 1372 bp, Homo sapiens
  Payload ID: 4391
  Gene Symbol: COA1
  Gene Name: cytochrome c oxidase assembly factor 1 homolog
  ENST ID: ENST00000418140
  CDS Start-End: 195-386
aagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaagtaagtatcctgctagccgcctgcggcctgacctcctcctagcctgctcctgctcctccatcagaggaaatacttgagatgctttgtttagattagagaaaggaggagagggtgattttaaaggctagtccaccatttcgttggctatagcttcctctgtatcctgtaatctcagtttttccaggagcaacgagtacaaataaaaggaccaggactaatatgcataagaagcccagcaaagcacgatgggctttcagtccagtgcacacacaggggctccatcaagattctgagattatataaagaagggacagagggaaggggaataccagatggttcacaggtggggaaagctgtggctgtgcgtccagcattgtcagactttttttgcactttcattctctgctgttgatttaatggaggagggaccatgagcaaggaactctggcaggggcagaaaataaaagcagagaccacgatggcaaaatcccgacagatgccgcttccagccccactgcactcaaatttgaatttgtaaagacaggccacaattactgtcagcagccaggacatttaaggtcattttaatgctactggtggcaaagcggcagcagttttttctagactggctttttttaggctcctttatccccacccagcttggctcgtcatccactctgcaacattttcacttcttcccaggatgtgagtgtcaccagcagacaagcagacaggctccagtgtcctctccagcctttctgcaccatcctgcagagttggtggagttgcagagtctggagggggcctgagatgagcgttcccaggaatgattcagactgaataatttggcctcctcttccctctgccaaagggacaggggcaggacatgagagggatgggtgcacttttgggtcagggttcagctttctggtgtgacagcctttctcccttaggaggctgctaagtcggtgagacctgggcactgcagccgactgcctgggttgaatggttgaatctcggctccagctcttgaccagctatgtggccttatgggggagtccgt

SEQ ID NO: 124236 - DNA, 585 bp, Homo sapiens
  Payload ID: 4391
  Gene Symbol: COA1
  Gene Name: cytochrome c oxidase assembly factor 1 homolog
  ENST ID: ENST00000451651
  CDS Start-End: 186-311
agaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaagaggctgctaagtcggtgagacctgggcactgcagccgactgcctgggttgaatggttgaatctcggctccagctcttgaccagctatgtggccttatgggggagtccgtcacctttctgggcattagttaccttattggtgtgatgtgtggtaatgttagtgcttgtgtatgaggtgagaattgaatctcacaacacaagagctgttgaacattgtgagatgtgtggaatattgagaacagtgcctagccatagaaatcactcaataaagattagctgtctgga

SEQ ID NO: 124237 - DNA, 1177 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000446564
  CDS Start-End: 195-635
aagcctggaagaactcgtcatgctctttgtagcgtggtgcttctgttgctcacaggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgttgcacctggacttgatatgaaagtaaccatcagaaaatcaacagagatcttaaacttgcctaccacagacacctgcaggaatatactaagaatcatcatagtggacctttattgtctcctgagcacccattctttgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaag

SEQ ID NO: 124238 - DNA, 1520 bp, Homo sapiens
  Payload ID: 4391
  Gene Symbol: COA1
  Gene Name: cytochrome c oxidase assembly factor 1 homolog
  Uniprot ID: Q9GZY4
  ENST ID: ENST00000446330
  CDS Start-End: 124-564
aggaccgcgggcatttacccgtgctttcccaagcctggaagaactcgtcatgctctttgtagcgtggtgcttctgttgctcacaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaagttgaagattcctgtctctggatccaaatcagagggccttctctacgtccactcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggcccatctcagtgacagacactcctgcaacccagttttccagccaccagtgggatgatgttgcacctggacttgatatgaaagtaaccatcagaaaatcaacagagatcttaaacttgcctaccacagacacctgcaggaatatactaagaatcatcatagtggacctttattgtctcctgagcacccattctttgttctttcagaaacacaactggttttgagaatccatcccttcttcactcagtccacgtaaaggttaggatggtagaaagtgttatacctcttcctccagagttggagcctatgacactgatgacactggcatggaaagccaaagccctacaccaaccagcacacttactggttccaaattgatctacgctggtgtaatcagagtgaatctcagaactttggacagagctgtgagcagagactgactttcctgctgtctccaggtagctgcaaggctgaacagcagcacctactttattaccatcttactgtcattcaaagaaggcagagctgaatgctggagaaaaactgagtactagcaacagtttttgaaccctgaatactgtcataactgaagctagaattatccctggacttgtttgccactaaaatttccttgttttgcttaccctggtttcagctggcaccctgatcacttgaaaggaacataactgatatactgtcctttgtttttctttccttcctcttctccgcctttgatgattttaaattagaaatctacctgcctctaatctctttaattttctcatttatttactgctgcctattttccaaaacactgcttctcgaatattcctggctcaaaaatcatctatgtcttcatgacatatgaaacccctagaatcca

SEQ ID NO: 124239 - DNA, 720 bp, Homo sapiens
  Payload ID: 4391
  Gene Symbol: COA1
  Gene Name: cytochrome c oxidase assembly factor 1 homolog
  ENST ID: ENST00000431651
  CDS Start-End: 457-720
gggcatttacccgtgctttcccaagcctggaagaactcgtcatgctctttgtagcgtggtgcttctgttgctcacagaggtgcctgcttccccttctgccatgattggaagtttcctgaggcctccccagccatgtggaactagtggttcagatttactttcccggagtagtcacaggactgggcagtgaaaacaggttgacttggatcagctgatggttcttttgtcccatggatgttctgctggtactgcagtcatctggtagcccacttaaactagaatgtccatgacagctcattcacatggctagtgccttggatgtttgccacacgagtcactcgagagaatctctgagtcctggcgagggctttctgaggcttcgtgtgttagcagctgttgtcttccaactcagcggcaggacaacttgcctttgatgattttcaagagagttgtgctatgatgtggcaaaagtatgcaggaagcaggcggtcaatgcctctgggagcaaggatccttttccacggtgtgttctatgccgggggctttgccattgtgtattacctcattcaaaagtttcattccagggctttatattacaagttggcagtggagcagctgcagagccatcccgaggcacaggaagctctgggccctcctctcaacatccattatctcaagctcatcgacagggaaaacttcgtggacattgttgatgccaag

SEQ ID NO: 124240 - DNA, 771 bp, Homo sapiens
  Payload ID: 4392
  Gene Symbol: COA3
  Gene Name: cytochrome c oxidase assembly factor 3
  Uniprot ID: Q9Y2R0
  ENST ID: ENST00000328434
  CDS Start-End: 24-344
accgcgaagggaggagtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttatggttacaccttctactcgatttcccaggagcgtttcctagatgagctagaagacgaggccaaagctgcccgagcccgagctctggcaagggcgtcagggtcctaatctggatgggtattgatcatgtccaacctgctggagccccttcacatggtggatgatgccccatgaccctgtagaaattgaatcctgctcacaacattgttggccttcttactaaccttggaccgtgattgagcccaagaaaccagggacttacgcatttggccaatgtcaaaagaacagaactttgcccactgcacacttgctgtgtacaatgactgagccctttcttgtagtttgtttccttgtttgagaggtgtgcatgcgaccgtggcttttcccaaagtttctgactttgtggtttacccccttcaccttccagggacgcagttgttacgaggttagacgtggcagctctgtgcagtgtttgagcctacagtgggatacatagggtcaaattgagaataataaactgagtcattctcctgga

SEQ ID NO: 124241 - DNA, 1374 bp, Homo sapiens
  Payload ID: 4392
  Gene Symbol: COA3
  Gene Name: cytochrome c oxidase assembly factor 3
  ENST ID: ENST00000586680
  CDS Start-End: 10-225
agtggcaacatggcgtcttcgggagctggtgaccctctggattctaagcgtggagaggccccgttcgctcagcgtatcgacccgactcgggagaagctgacacccgagcaactgcattccatgcggcaggcggagcttgcccagtggcagaaggtcctaccacggcggcgaacccggaacatcgtgaccggcctaggcatcggggccctggtgttggctatttaaagcatcagattctgagaacacaagctccatggtgggccctggtgtgggggagatacatggcttctgttctgaattcactggagggaaaagaaaaagtgatgaagaaacctccaaggtgggaggaaggcgaagctgcagccagtgtctgtagtgtttccacctctgacaagtgcctgaggatgcacggagggcatgaaagggctagccacacaccttgctctcccaggttctcctctcactcctccatcctcccgagactcacttctgccgaagactctgcagctcagcccagaactcctcatcttccccactgctttctgactcctcgctgctcaaacacaggctgctgtaggagtagttcatccacactgggctgggatggctcaggggttgggggctgcccccaacttggggttccttcccatcatctccttcctcctcaactccagcccccagaccctcagctgcacggtcgctctcagccagagcttccctggtctctggcccgcctccagcactgtcctctgtatctgagctctctgaagtgagctgaggggttgaaggttttggagaaccagagagagtgggggatgttggctgcaagggaagaggctcagccggttccttggatgaagtcacttggaaacgcccaacaagctgcggctttccctctgtagggcgacgaggaagaaggcatgaggaaaggagagcagtgacaggacagacagtgagtagggataatggcaggggaaggtcagtggtcagaggccttaccttcagagatgggcgccagcctggcttcccctgggaggggccgagcaggaggtggtgaggcctagaaagtggggggccatgagaagggaagagtgcagagtggagtctccctaatcatccctcttggttttctactcacctcactctccacctcagctgtgtggggtgaagggctttcctggccaccaggagcaacgggagggggaaggggcaggctagggaggggactaggaggggctggaggagactgggaaaggagcccaggtgagggggacagcagggactgggccacagtcatcacagccagtgagaaggcactagccagagaaaggagaggggctgctgtggtggaggggaaggaagaagtggaggggc

SEQ ID NO: 124242 - DNA, 960 bp, Homo sapiens
  Payload ID: 4393
  Gene Symbol: COA4
  Gene Name: cytochrome c oxidase assembly factor 4 homolog
  Uniprot ID: Q9NYJ1
  ENST ID: ENST00000355693
  CDS Start-End: 249-512
ccccttcccggaagtgagtccccgagaagcgtgcggcgaggacagaggtgggctcaacaccaagaggccaccaatgaaaacgtgactttttcacattccccgccccttccgtgtgcacgctccccacgaggggctggttcctgaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattcaaa

SEQ ID NO: 124243 - DNA, 582 bp, Homo sapiens
  Payload ID: 4393
  Gene Symbol: COA4
  Gene Name: cytochrome c oxidase assembly factor 4 homolog
  Uniprot ID: Q9NYJ1
  ENST ID: ENST00000537289
  CDS Start-End: 201-464
aggatgtacagaggatccccaaccgcctgcgaaacccaagccgccgcgtaggagcgtgcgttcgggccctcttctcccacctgttcggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttg

SEQ ID NO: 124244 - DNA, 1038 bp, Homo sapiens
  Payload ID: 4393
  Gene Symbol: COA4
  Gene Name: cytochrome c oxidase assembly factor 4 homolog
  Uniprot ID: Q9NYJ1
  ENST ID: ENST00000541455
  CDS Start-End: 395-685
cattttttttcttttttctttttttttgagatggagttttgctcttattgcccaggagtttgagaccatgctgagcaacatggaaaaaccttgtctctattaaagaatcaaaaaaattagctgagtggtgatgcacacctgtagtcccagctactctggccagggagggactgagggggaaggattgcttgatccctaaagatggaggctacagtgagcctgggcaacaaagcaagacaccctcaaaaaaaaaaaaaaaaaaacaagcatctgtcttcaagcttagagtctcccacgggagacagacacattaaacaggctaaatggtgcagtctggtcagtgctatttataatttaggaaccttacatattatatccctactctaacctgttaatgttctatagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattga

SEQ ID NO: 124245 - DNA, 922 bp, Homo sapiens
  Payload ID: 4393
  Gene Symbol: COA4
  Gene Name: cytochrome c oxidase assembly factor 4 homolog
  Uniprot ID: Q9NYJ1
  ENST ID: ENST00000545127
  CDS Start-End: 213-476
ctcaaagttcaaagtcctcgatacgcctgaggcgcctcaggcctcgtggctgccagcatttttctgctttaagatcctttccatgacttccttgtttaggccagcctccacgatccagctgccaaccatctagcctaccctgatctctgagcaggggtcgtcgtcattttactccagaggagactgaagccaaaagactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccagtagatggccctgccaagaccagcacccagcaagattatagaggaagaaatcctaaatgctggtgtgggaggtctaaaacatggggagagtttttggatctggagttgagagccatgggtttggacatgactggcacaaacagctgtcatatgttcatggtcagatgtcatacattctcagctgtcttgttccaccagtatttaccaggaaaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatggggaaactttttattca

SEQ ID NO: 124246 - DNA, 1754 bp, Homo sapiens
  Payload ID: 4394
  Gene Symbol: COA5
  Gene Name: cytochrome c oxidase assembly factor 5
  Uniprot ID: Q86WW8
  ENST ID: ENST00000328709
  CDS Start-End: 88-312
tgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaagaagccaaaacaggaaacatactttttactacatctgtttggttggaccagatttcccctccgtggaacactgaagaaagtggatgagttgttttcgaatatgtataaagtaaatgattctcttgatccaagttatttttagaagaaaaacctaattgaacaggtatgggttgggagcataataaatgtgttttgagaattgttctaaagcacagaaaatggaaagactgttatttgcaaacttgactcttcaattgaattacccaattagtacaggccactgatttgactgacacagtcgataacatgcagcctatccagaaggtgtctgttgggaaagtttaggataaaactttttctttagttcagtcttttcctgtctagttctaaaatgaattgtgtttgattccttagagaagaaatacttcatttgtgctctgattcactgaagtaataacctcagcactttaatagcgtccacaggcatagctgatgctaggccccagattgtgttgcccaggctctttaccatcatcttcggactgtttttgtttcctggttacattttcagtctggcccgctctacataatgggccagtgtcagctccaagtccacatccttattatccatgattcaaaagggagagagagaacttcctttttcagggtccacaaatcaaatctataaaaggactctggtcttcccaggatcacctgcccttgcattggaccagtccctgtggaagaggggatgggggcctgtgatcttggccaggcctgggctatctatctgcactgtcattgctaactcctgtcagaatcacatggatgagtagtgggctgaatcccaaaaggaaaggggtttagagcaagtggaaacaacagatgttcactatagaaagcaagaatgaaaaccatgaagtggttgaagattagccttacagtaattttattctgatcacttaatacagtagagtcaaacaggaatccaagtttccaactttattatttttggcactgaagaattacaaagaactctagcgtctttatacctccgtggttcactggagttaaagcaatcggggcgttgtacagctcacttgagtttttaaaggttctactaaaaagtgagaattccacagcaatatgggtcattgttgcagaatatcacaaaggtctgttgtgtatactccttttcaccaggaaagggacaataatagtttttttcaatgtatatatatataagtgatctaactttttattaataaaagtaaacaactctaaaatgtatattataaagccctgtcatctttgttgagtaatagctttattgagctttatttggagaaatacacataccgtaaaattcacactgaaactta

SEQ ID NO: 124247 - DNA, 557 bp, Homo sapiens
  Payload ID: 4394
  Gene Symbol: COA5
  Gene Name: cytochrome c oxidase assembly factor 5
  ENST ID: ENST00000409997
  CDS Start-End: 111-332
gttgccgctggcttccggtcccctgagactggggcctcgctcgctcccgacccggttgcaagtgttgcggtgggagaaagtcgcgtccgcatcggaggggaagcgccgtcatgcctaagtattatgaggacaagccgcagggcggcgcgtgcgcgggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgatggagtctcgctctgttgcccgggctggagtgcagtagtgtgatcttggctcgctgcaacctctgcgtcctgggttcaagtgattctcgtgcttcagcctcccgagtagctgggactacaggcagctgccaccatgcccagctaagttttatatttttagtagagatggggtttcgccatgttggccaggctggtctcaaactcctgatccacccacctctccctcccagagtgctgggattacaggcatgagccattaacac

SEQ ID NO: 124248 - DNA, 1013 bp, Homo sapiens
  Payload ID: 4395
  Gene Symbol: COA6
  Gene Name: cytochrome c oxidase assembly factor 6
  Uniprot ID: Q5JTJ3
  ENST ID: ENST00000366612
  CDS Start-End: 546-785
gtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttaggttcgaacagtaaccctgtaaactaggcactgctgtccccgctttactggtgggaaacgggctcggagagaataaatgagctgccctaagcgactgggacagaaccacagttctcagccgggctttctgagcccacgctgccgccccagcagggatcaaatcacacagtgtgagataagcctcaagagcgggtggccttatgctgccactgagaactgattgggttcagttgcctcatcaaaatccctaagcatggttttgttttgtttttgtttttttttttttttttagttttaaaggaagaggagattgacggttttcctctttccttatcttctcttcagattacaaagttcattgttaatctcaaatattattttggccaacagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacat

SEQ ID NO: 124249 - DNA, 641 bp, Homo sapiens
  Payload ID: 4395
  Gene Symbol: COA6
  Gene Name: cytochrome c oxidase assembly factor 6
  Uniprot ID: Q5JTJ3
  ENST ID: ENST00000366613
  CDS Start-End: 37-414
gcttgctgatgggtccgggtggggcgcgcgtggactatgggcccgggaggtcccttactgtccccgagccgcgggttcctcttgtgcaaaacggggtggcactccaatcgcctgcttggtgattgtggcccccacacacctgtttctacagcgcttagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacaca

SEQ ID NO: 124250 - DNA, 710 bp, Homo sapiens
  Payload ID: 4395
  Gene Symbol: COA6
  Gene Name: cytochrome c oxidase assembly factor 6
  ENST ID: ENST00000366615
  CDS Start-End: 12-479
atggaaagtaaatggtagctcggaagggtcaaaagagtccgcggtttcgccgcgtgagttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatgca

SEQ ID NO: 124251 - DNA, 697 bp, Homo sapiens
  Payload ID: 4395
  Gene Symbol: COA6
  Gene Name: cytochrome c oxidase assembly factor 6
  Uniprot ID: Q5JTJ3
  ENST ID: ENST00000619305
  CDS Start-End: 228-467
tggtagctcggaagggtcaaaagagtccgcggtttcgccgcgtgagttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctaggctgttcataaagattgaaagtattctttctggacattgaaaaagctccactgactatggaacagtaatagtttgaatcatagtgaacatcaatacttgttccctatatacgacacttgataattaagatgatcaagaaccagaagatctgtgaagaaatgaaataaaatggtatttagtaagaaatctctattttaagaaaaaaagtaaaacctgttataaacacatgc

SEQ ID NO: 124252 - DNA, 4005 bp, Homo sapiens
  Payload ID: 4396
  Gene Symbol: COA7
  Gene Name: cytochrome c oxidase assembly factor 7 (putative)
  Uniprot ID: Q96BR5
  ENST ID: ENST00000371538
  CDS Start-End: 41-736
tccgccggctcacgtgaccgtctttgggccggcgcgaaccatggccggcatggtggacttccaggatgaggagcaggtcaagtcctttttggagaacatggaggtggagtgcaactaccactgctaccacgagaaggacccggacggttgctatcggctggtggactatttggaagggatccggaagaattttgatgaggctgccaaggtgttgaagtttaactgtgaagagaaccagcacagtgatagctgctacaaactgggggcctactatgtgactggaaaaggtggtctgacccaggacctgaaagctgccgccaggtgctttttgatggcgtgtgagaagcctggaaagaagtcaatagcagcatgtcacaacgttggcctcctggcacatgatggacaggttaatgaggatggccagcctgacttgggaaaggccagggactactacacaagggcctgtgatggtggctatacttccagttgcttcaacctcagtgccatgttcctgcagggtgccccaggctttcccaaggacatggacctggcatgtaaatactccatgaaagcctgtgacctgggtcatatctgggcctgtgccaatgccagtcgcatgtacaagctgggggatggtgttgataaggatgaggccaaggccgaggtgctaaaaaatcgagcccagcagctacacaaagaacagcagaaaggtgtccaacccttaacatttgggtaatgtggtccaccctccctcccaggcaacaaactgcttgaggctggcagctcctgtttctgaagactgatgcagcccttgaaggtcaacctgctggagcaaaaaaacttgggacttgaatttgtagctccatttacatggatccattgccccagctactggagtatagcctacaatgtttatttcagtcaatattcctttatctgggtgttctgtacaatgtttattacagtcaatattccttcatctggatgttctgtgaagatagccatgtttatgggggtcttagttttcaaactctggcaactctgtgaaaaataggagcaaactagagagccctggagattggtagtagggaagggaggatagcaggaagtttgaaaaattagcagccccggggcctaaaggaatcagctgtcatcattttcatcattattattttggttaggatggcttgaaaatcagaacgtatcttggtttacgtaattgaggtcttaaagaactaagaacagttaaatagtcacaactaccaccctctgacttacataatcattggtgtgggcttcgttttgcctttagagtcacatctttcagtaaattcacagagatcaagagggacgtgcaacatacagcttaaaggctgttatgcttcagggttgctgaagaagatgaaacatcagcctgccatcgtctagaagagacattggcagttaaaaattagcacctccagtgtagtcgcctggcactgcccatcatgctgagggagcagattcttcccaaggcagcttcagctaggagtttgtaagcaaggactttgtgacacatttgtcccctggaactgagcctttttaactgtccctgtgaatgaacaattttgagtgacctacggtttgtgttaattagtgttctttccagattccaggtaccgtagagagtatgttctttgtggtggttgtgccttttaagaacatttgtggccgggcacggtggctcacgcctgtaaccccagcactttgggtggccaaggcgggtggatcacgagatcaggagatcatgaccatcctggctaacacggggaaaccccatctctactaaaaaatacaaaaaattagccgggcgtggtggcaggcgcctgtagtcccagctactggggaggctgaggcaggagaattgcttgaacccgggaggcggagcttgcagtgagctgagattgcgccactgccctccagcctgggcgatagagtgagactccgtctcaaaaaaaaaaaaaaatttgctttttctgttgtctccccagcttgtcaccagggggcgagcttgccatttccctgctggtaacaataccattctgtcaccatctactgttttaggcttccgttttgcagccgtcctgaaaggaaggcttgctgtgtaaatgaaggcttgtgagcacagcagccagcctctcaagttgatagaggacagggacttccccaagtgcacagaggagatttcaaaagacatcaaattcactttttaaaaatgtaaagtagcttttggtgtgcttaaactaggtcaggccaggcgtggtggctcatgcctgtaatcctagcattttgggaggccaaggcaggtggatcacttgaggtcaggagttcgagatcagcctggccaacatgacgaaacccctttctctactaaaaatataaaaattagctgggcgtggtgatgcatacctgtaatcccagctacttcggaggctgaggcaggagaatcacttgaacctgggaggcagaggttgcagtaaactgagactgtgccactgcactccagcctgggcaacacagcaagactctgtctcaaaaacaaaaacaaaactaggccaggtgcagtggctcacgcttgcaatcccagcactttgggaggccgaggcaggcggatcacgaggtcaggatttcgagaacagcctggccaacatagtgaaacctcgtatctactaaaaatacaaaaattatctgggtgtggtggtgggcacctgttgtcccagctattcaggaggctgaggcaggagaatcgcttgaacccaggaggtggaggttgcagtgagccaagaccatgccattgcactccagccaggtaacagagtgagactctgtctcaaaaaaacacacacacacacacacacaaaactgtaggtcaaaaaacatgaaaatatgttcaacatcactaattagggaaatgtaaatcaaaaaccacaatgaactcttaaaattcaacagtaagaaaacaacctgattaaaaacaggccaaaacccttaacatatctcagcaaagaagatagacaggtggcaaataagcatatgaaaagatgttccatataacatgtcatcaggaaaatgcaagttagaacaacagaccactatacaactattagaatggccaaaatccaaagcaccgacagcatgaaatgctgggaaagttggagcaaccagaactcttattccttgctggtgggaacgcaagatggcacagccactttggaagacagttaagcagtttcttacaaaaactaggtaagctcttaccatgtgatccagcaatcttgctctttagtatttacctgaaggaactgaaaacatgtccacacaaaaaccagcacatggatgtttatagcagctttatctataattgccaaaactcaacccaaaatgtctttcagtaggtaaatgggtaaataaattgtggtgcatgtagtcattattcagtgcttaaatcaagctatgacaaattatgagttatcaagctataagaagtcacagaggaacttaaatgaatgctactaaatgaagccagtctgaaaaggcttcatattaaatgatgccaactatatgacactgggatgtattctggaaaaggcaaaactatggagacagtaaaaagcagtgggtgggggaggggagggaggaataattggagcacagaagatttttagggcagcgaaactactctgtatgatactataattataaatacctgtcattgtacatatgtccaaccccctaaaatgtacaacaccaagagtgaaccctaatgtaaactgtggactttgagtgataatgatgtgtcagtgtaggttcatcaattactgcaaatgtacctctttggtgggagatgttgaaaatggtggagactatgcatgtgtggggacaacaactatatgggaaatctctgtaccctctcaattttgctgtaaacctaaaattgctctaaaatataaagtctattaaaaccac

SEQ ID NO: 124253 - DNA, 2356 bp, Homo sapiens
  Payload ID: 4397
  Gene Symbol: COX15
  Gene Name: cytochrome c oxidase assembly homolog 15 (yeast)
  Uniprot ID: Q7KZN9
  ENST ID: ENST00000016171
  CDS Start-End: 52-1284
agaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccgggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaa

SEQ ID NO: 124254 - DNA, 2788 bp, Homo sapiens
  Payload ID: 4397
  Gene Symbol: COX15
  Gene Name: cytochrome c oxidase assembly homolog 15 (yeast)
  Uniprot ID: Q7KZN9
  ENST ID: ENST00000370483
  CDS Start-End: 52-1218
agaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacagggccctgtcttattcaactttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 124255 - DNA, 708 bp, Homo sapiens
  Payload ID: 4398
  Gene Symbol: COX4I1
  Gene Name: cytochrome c oxidase subunit IV isoform 1
  Uniprot ID: P13073
  ENST ID: ENST00000253452
  CDS Start-End: 71-580
gcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaa

SEQ ID NO: 124256 - DNA, 1481 bp, Homo sapiens
  Payload ID: 4398
  Gene Symbol: COX4I1
  Gene Name: cytochrome c oxidase subunit IV isoform 1
  ENST ID: ENST00000564903
  CDS Start-End: 5-385
cagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtcggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccttaactactttgtacagcacaccacgttttcagtagcaatttatgtgctcaccagtcacttagcgaaagatgacttcgtgaaggttcgagcaaggataaggggactcattcattgaatgactgtctggactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacagacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttg

SEQ ID NO: 124257 - DNA, 566 bp, Homo sapiens
  Payload ID: 4398
  Gene Symbol: COX4I1
  Gene Name: cytochrome c oxidase subunit IV isoform 1
  ENST ID: ENST00000565078
  CDS Start-End: 438-566
tttacactttgccagataaggaatcggctctgcgaaggtgcgaagaaccaaatcctagcgattaatgtcccaacaacgtgaacacttcctgcaactcgaaatcctcaagggaaactctgtcgaatccccaccaagtgaacgatgacttgtttctacaaaggctactgatttcaggaaactaacgtataactcgtcgccttaaagtgcctctaaaagcatccacgacggttaaagtcgctgctactacgggacgctatttattcagcgccaagacccaagcgccatcgtggatcaccccattcctggccacggcaaccctagggagcgggtcctaggagcctgctggagggcgaccgctgggccagcttcctctctgctgactgaggggaggccaggctgcctgcaaggggaaggggccctttccgcgcttaccaggaatgttggctaccagggtatttagcctagttggcaagcgagcaatttccacctctgtgtgtgtacgagctcatgaaagtgttgtgaagagcgaagacttttcgctcccagcttatatggatcggcgtgac

SEQ ID NO: 124258 - DNA, 794 bp, Homo sapiens
  Payload ID: 4398
  Gene Symbol: COX4I1
  Gene Name: cytochrome c oxidase subunit IV isoform 1
  ENST ID: ENST00000568794
  CDS Start-End: 72-491
cgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggac

SEQ ID NO: 124259 - DNA, 490 bp, Homo sapiens
  Payload ID: 4398
  Gene Symbol: COX4I1
  Gene Name: cytochrome c oxidase subunit IV isoform 1
  ENST ID: ENST00000566405
  CDS Start-End: 167-490
ttccggtcgcgggacaccgggtgtagagggcggtcgcggcgggcagtggcggcagaatgttggctaccagggtatttagcctagttggcaagcgagcaatttccacctctgtgtgtgtacgagctcatgtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctg

SEQ ID NO: 124260 - DNA, 471 bp, Homo sapiens
  Payload ID: 4398
  Gene Symbol: COX4I1
  Gene Name: cytochrome c oxidase subunit IV isoform 1
  ENST ID: ENST00000566115
  CDS Start-End: 117-245
gccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgtagagacggggtttcaccatgttagccaggatggtctcgatctcctgacatcgtgatccgcctgcctgggcctcccaaagtgctgggattacaggtgtgagccaccgcgcccagccctgcagaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaa

SEQ ID NO: 124261 - DNA, 617 bp, Homo sapiens
  Payload ID: 4398
  Gene Symbol: COX4I1
  Gene Name: cytochrome c oxidase subunit IV isoform 1
  ENST ID: ENST00000564544
  CDS Start-End: 47-298
gggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagtgtgggtattgaagggacccacaggcgcgcccagcagctctcggaagcgttgtatcgcattaagttcaaggagagctttgctgagatgaacaggggctcgaacgagtggaagacggttgtgggcggtgccatgttcttcatcggtttcaccgcgctcgttatcatgtggcagaagcactatgggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccact

SEQ ID NO: 124262 - DNA, 716 bp, Homo sapiens
  Payload ID: 4398
  Gene Symbol: COX4I1
  Gene Name: cytochrome c oxidase subunit IV isoform 1
  Uniprot ID: P13073
  ENST ID: ENST00000561569
  CDS Start-End: 79-588
cttccggtcgcgggacaccgggtgtagagggcggtcgcggcgggcagtggcggcaggtgtacatttttatctttcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaa

SEQ ID NO: 124263 - DNA, 873 bp, Homo sapiens
  Payload ID: 4398
  Gene Symbol: COX4I1
  Gene Name: cytochrome c oxidase subunit IV isoform 1
  Uniprot ID: P13073
  ENST ID: ENST00000562336
  CDS Start-End: 194-703
ctctcttccggtcgcgggacaccgggtgtagagggcggtcgcggcgggcagtggcggcaggtgagacaggaggtggccggtgcggcgccgccaggccgggccgggtcggggggccgggagccatcaagtctgcacgtccgcagcctggccgctcggcttcagcaggaagcaccgaatgggcctcggagccagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagcta

SEQ ID NO: 124264 - DNA, 693 bp, Homo sapiens
  Payload ID: 4399
  Gene Symbol: COX4I2
  Gene Name: cytochrome c oxidase subunit IV isoform 2 (lung)
  Uniprot ID: Q96KJ9
  ENST ID: ENST00000376075
  CDS Start-End: 76-591
caggtccctccgcagcgggttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttgtaccggctccagttcaatgagacctttgcggagatgaaccgtcgctccaatgagtggaagacagtgatgggttgtgtcttcttcttcattggattcgcagctctggtgatttggtggcagcgggtctacgtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaaaaaaaa

SEQ ID NO: 124265 - DNA, 1268 bp, Homo sapiens
  Payload ID: 4400
  Gene Symbol: COX5A
  Gene Name: cytochrome c oxidase subunit Va
  Uniprot ID: P20674
  ENST ID: ENST00000322347
  CDS Start-End: 155-607
cggtggctcctcccgcccacgcgccagagtcgcagtgggcgggcctacgtgctccgcccgctgtgagcctgtccggcccccgcccgctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgtaaatttggaggcattctgattaaacagctgagtaaaacaaa

SEQ ID NO: 124266 - DNA, 571 bp, Homo sapiens
  Payload ID: 4400
  Gene Symbol: COX5A
  Gene Name: cytochrome c oxidase subunit Va
  ENST ID: ENST00000568783
  CDS Start-End: 70-531
gctccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaac

SEQ ID NO: 124267 - DNA, 441 bp, Homo sapiens
  Payload ID: 4400
  Gene Symbol: COX5A
  Gene Name: cytochrome c oxidase subunit Va
  ENST ID: ENST00000562233
  CDS Start-End: 57-311
ccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 124268 - DNA, 582 bp, Homo sapiens
  Payload ID: 4400
  Gene Symbol: COX5A
  Gene Name: cytochrome c oxidase subunit Va
  ENST ID: ENST00000568517
  CDS Start-End: 233-442
ctgcccgccgcctcgagtagtggaggacctgaaagcgcgcccccggggcctccccccgcgcaacttcctggctgtgccaccgcggacagctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaact

SEQ ID NO: 124269 - DNA, 568 bp, Homo sapiens
  Payload ID: 4400
  Gene Symbol: COX5A
  Gene Name: cytochrome c oxidase subunit Va
  Uniprot ID: P20674
  ENST ID: ENST00000564811
  CDS Start-End: 53-505
gagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggctatccagtcagttcgctgctattcccatgggtcacaggagacagatgaggagtttgatgctcgctgggtaacatacttcaacaagccagatatagatgcctgggaattgcgtaaagggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatgggtaagcgacaaaccactgaagaaggcaggaaaacaatccagagaggtgtgggtg

SEQ ID NO: 124270 - DNA, 579 bp, Homo sapiens
  Payload ID: 4400
  Gene Symbol: COX5A
  Gene Name: cytochrome c oxidase subunit Va
  ENST ID: ENST00000567270
  CDS Start-End: 67-402
ccggagcaacccgcgagcttacaccggcttctctctgtcctcagcccgcgcgccgccatcgccgtcatgctgggcgccgctctccgccgctgcgctgtggccgcaaccacccgggccgaccctcgaggcctcctgcactccgcccggacccccggccccgccgtggggataaacacacttgttacctatgatatggttccagagcccaaaatcattgatgctgctttgcgggcatgcagacggttaaatgattttgctagtacagttcgtatcctagaggttgttaaggacaaagcaggacctcataaggaaatctacccctatgtcatccaggaacttagaccaactttaaatgaactgggaatctccactccggaggaactgggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 124271 - DNA, 712 bp, Homo sapiens
  Payload ID: 4401
  Gene Symbol: COX5B
  Gene Name: cytochrome c oxidase subunit Vb
  Uniprot ID: P10606
  ENST ID: ENST00000258424
  CDS Start-End: 48-437
gtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccatagatggctggtcttatttcttacccgtattctttggtaggcatggaatatgcttattttgggaaaagctgtctgttaatgctagcttgccatccacttactgaaagtgtataaccagtgtatagtgcttagattaataataagaatagatcgacaacccgtaatgcaatgaatgggaccacctggtatga

SEQ ID NO: 124272 - DNA, 572 bp, Homo sapiens
  Payload ID: 4402
  Gene Symbol: COX6A1
  Gene Name: cytochrome c oxidase subunit VIa polypeptide 1
  Uniprot ID: P12074
  ENST ID: ENST00000229379
  CDS Start-End: 38-367
acttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatga

SEQ ID NO: 124273 - DNA, 440 bp, Homo sapiens
  Payload ID: 4403
  Gene Symbol: COX6A2
  Gene Name: cytochrome c oxidase subunit VIa polypeptide 2
  Uniprot ID: Q02221
  ENST ID: ENST00000287490
  CDS Start-End: 104-397
agtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctgaggccccggacgcccccggacacaataaaggtgtgaagcttcga

SEQ ID NO: 124274 - DNA, 667 bp, Homo sapiens
  Payload ID: 4404
  Gene Symbol: COX6B1
  Gene Name: cytochrome c oxidase subunit VIb polypeptide 1 (ubiquitous)
  Uniprot ID: P14854
  ENST ID: ENST00000246554
  CDS Start-End: 193-453
tgggcgtggcttgaatgacttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgagactatgcgtgtgaacgggccaggcagtggcaagaagctgggctggaatcagtgccctgaccagggaggggcttgaatg

SEQ ID NO: 124275 - DNA, 435 bp, Homo sapiens
  Payload ID: 4404
  Gene Symbol: COX6B1
  Gene Name: cytochrome c oxidase subunit VIb polypeptide 1 (ubiquitous)
  Uniprot ID: P14854
  ENST ID: ENST00000392201
  CDS Start-End: 96-356
catcctcccttttggacgttggaggggccgcagcgtcatctccgatgcaccctcatcctcagataccgggtagagatctcgccggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatcccc

SEQ ID NO: 124276 - DNA, 660 bp, Homo sapiens
  Payload ID: 4404
  Gene Symbol: COX6B1
  Gene Name: cytochrome c oxidase subunit VIb polypeptide 1 (ubiquitous)
  Uniprot ID: P14854
  ENST ID: ENST00000592141
  CDS Start-End: 266-526
tagggcctgcgattatccccttttgtcagtaaacaggctcagagataccaagcgacctagctgaacctacacagcgaccaggatttggcccaggagtttgtcctccagggctcttcatggctaattcacaggcgtggcctctcgcggcttgcctgggccgcagcctggctcccgggtgtccagtccatcctcccttttggacgttggaggggccgcagcgtcatctccgatgcaccctcatcctcagataccgggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtg

SEQ ID NO: 124277 - DNA, 290 bp, Homo sapiens
  Payload ID: 4404
  Gene Symbol: COX6B1
  Gene Name: cytochrome c oxidase subunit VIb polypeptide 1 (ubiquitous)
  ENST ID: ENST00000590618
  CDS Start-End: 1-122
tggcggaagacatggagaccaaaatcaagaactacaagaccgccccttttgacagccgcttccccaaccagaaccagactagaaactgctggcagaactacctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaa

SEQ ID NO: 124278 - DNA, 1663 bp, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENST ID: ENST00000326529
  CDS Start-End: 184-450
gcggtgcacgacggctcccattggctggggctcgggcgtcctagccaatccggccgcggggtgcgtttctcctgacccgggtgggaccgcaccccgcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaaga

SEQ ID NO: 124279 - DNA, 1396 bp, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENST ID: ENST00000590900
  CDS Start-End: 20-286
ggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcaggtagatgcctcgcgttgacagctacgagccagcccagggtccccagttctcaacactgtcccacccagatggctccaagggtgaccctagacaagcttcttgacctgtgtgagcccgaggttccccaaggcaaaccaagatggctcagggccccattatcagaggaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtccccagagccttgacgaatgcacagaggcgctggcagaaccacgggggcaggacccctctctgagtcacagaatggagctaagttggtgaggtcacccagccgccactgccccactgatgcctgagccaggggcaggggcagacctgcccggcctggcctccagcctggtggaccatcacctgtgcaaactccgaacacctcctccaggtgctctggctggctttccctggtgtccagtagccgcctcctgagacccctaatgccagcctcacagtctcagcaacctcccagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggt

SEQ ID NO: 124280 - DNA, 2083 bp, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENST ID: ENST00000593184
  CDS Start-End: 81-347
agaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtagatgcctcgcgttgacagctacgagccagcccagggtccccagttctcaacactgtcccacccagatggctccaaggccaaggagtgccgcttgacaaagccctagggttccagcctggtcctgctgagggagccgtgagaccagtcagcctggggtgctggttttcccaacgggtactccctgagctatcagccttccagaggggctcctaggagggggaagccccatcctctgactgaagcggtcctatgaggccctgttcaaccccagggttcaaaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtccccagagccttgacgaatgcacagaggcgctggcagaaccacgggggcaggacccctctctgagtcacagaatggagctaagttggtgaggtcacccagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacattt

SEQ ID NO: 124281 - DNA, 1944 bp, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENST ID: ENST00000588572
  CDS Start-End: 66-332
cccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatgcagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcctgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaagatttcagaaggttcctggaaattccaatgtccacccatgagtcctcagctgagactccctgctccgctgccctctttgtctaagagctgtggcaacagcacctgaatttcagaaacaaaaggccgggcgcggtggctcacacctgtcatcctagcactttgggaggcagaggcaggaggatcgcttgagctcaggagttcgagactagccttagcaacacagtgagacacaattgctacaaaaagattttaaaattagtttgacggggtggcgtgtgcctatggtcccagctactcaggaggctgaggcaggagaattgcttcaatccaggaggtggaggttgcagtgagccgagatggcgccactgcactccagcctgggccacagaccctgtctc

SEQ ID NO: 124282 - DNA, 479 bp, Homo sapiens
  Payload ID: 4405
  Gene Symbol: COX6B2
  Gene Name: cytochrome c oxidase subunit VIb polypeptide 2 (testis)
  Uniprot ID: Q6YFQ2
  ENST ID: ENST00000589467
  CDS Start-End: 89-355
gcggactcagaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtatgctgtt

SEQ ID NO: 124283 - DNA, 433 bp, Homo sapiens
  Payload ID: 4406
  Gene Symbol: COX6C
  Gene Name: cytochrome c oxidase subunit VIc
  Uniprot ID: P09669
  ENST ID: ENST00000297564
  CDS Start-End: 73-300
agcacggttcgtttttcctttagtcaggaaggacgttggtgttgagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatac

SEQ ID NO: 124284 - DNA, 571 bp, Homo sapiens
  Payload ID: 4406
  Gene Symbol: COX6C
  Gene Name: cytochrome c oxidase subunit VIc
  Uniprot ID: P09669
  ENST ID: ENST00000520271
  CDS Start-End: 212-439
ttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 124285 - DNA, 562 bp, Homo sapiens
  Payload ID: 4406
  Gene Symbol: COX6C
  Gene Name: cytochrome c oxidase subunit VIc
  Uniprot ID: P09669
  ENST ID: ENST00000522934
  CDS Start-End: 100-327
ttctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacactatgatgattctccacagtacctgcctcaaacaaaaatacaagagaaggatcacagttgaagacagttcaacagcaaaagaaatctgcagtct

SEQ ID NO: 124286 - DNA, 1098 bp, Homo sapiens
  Payload ID: 4406
  Gene Symbol: COX6C
  Gene Name: cytochrome c oxidase subunit VIc
  Uniprot ID: P09669
  ENST ID: ENST00000520468
  CDS Start-End: 456-683
actgcatgggatcggtattaatctgtttgtctttttcatcttctgggctgtgagctcctagaagtcagctttttcacttttacccaagccaaacggttattcgcgtaaggttggttataattaaaatgtcggtttgtgcacatggtttgggactctgtgtatgagtacgactaatatcttcaatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatctttaactgtgatagtttgtccgtttcattgcagttacttggtcttgggctatggattaaaaagtgttcttcatgagcctgtaagactactgtactgtgggctctaagaagagatagaatcctaataaaatctatccttggccttc

SEQ ID NO: 124287 - DNA, 694 bp, Homo sapiens
  Payload ID: 4406
  Gene Symbol: COX6C
  Gene Name: cytochrome c oxidase subunit VIc
  Uniprot ID: P09669
  ENST ID: ENST00000522940
  CDS Start-End: 337-564
tttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggtgggttgcgacggccccaccgaagccgggtgggctgcgggaccctcgagaacccagctggcttcggagtgagctggcccggggctggtacccgctgcgctttttcacagccattgtgaccttggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaa

SEQ ID NO: 124288 - DNA, 513 bp, Homo sapiens
  Payload ID: 4406
  Gene Symbol: COX6C
  Gene Name: cytochrome c oxidase subunit VIc
  Uniprot ID: P09669
  ENST ID: ENST00000524245
  CDS Start-End: 155-382
gcaggaggggaaggatgggcttcctgcaacctcccttgccccacggcttcccatcctacccccggccgcgttagctgaaggccagcagggacgcaaaagtttttaggccccttaggtctttaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaat

SEQ ID NO: 124289 - DNA, 745 bp, Homo sapiens
  Payload ID: 4406
  Gene Symbol: COX6C
  Gene Name: cytochrome c oxidase subunit VIc
  Uniprot ID: P09669
  ENST ID: ENST00000523016
  CDS Start-End: 74-301
cggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaaggtaatatggttatttgaagttacttaaaaaaaaatttctaattgtggtaaaatgcaaatacaggtgactgtccctcacaatgtttagacttaagattttttgactttacgatggtgtggaagtgatacacatttggtagaaaccatactttgaattttgatctttgtccacatgagcaataagtggcacaatacttttgtgatgtgggggagcaccaatgaccacatcccccagtcagaaacataatcacaagggtaaacagctgatgctgtactctgtagtgttgtgtgagatactcagtgttttattataagctaggctttgtgttagatgattttcttcagctgtaggctaacataagtgttctgagcacatttaaggtagggaaggctaagctatgatgtaagttaggtgtattaaatgcatttt

SEQ ID NO: 124290 - DNA, 429 bp, Homo sapiens
  Payload ID: 4406
  Gene Symbol: COX6C
  Gene Name: cytochrome c oxidase subunit VIc
  Uniprot ID: P09669
  ENST ID: ENST00000517682
  CDS Start-End: 70-297
acggttcgtttttcctttagtcaggaaggacgttggtgttgagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 124291 - DNA, 724 bp, Homo sapiens
  Payload ID: 4406
  Gene Symbol: COX6C
  Gene Name: cytochrome c oxidase subunit VIc
  Uniprot ID: P09669
  ENST ID: ENST00000518171
  CDS Start-End: 91-318
tgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggcctcccaaagtgttgggattacaggcgtgagccactgtgcctggcataattttggtattttttgatagtagccatcctaataggtatgaggtggtatcattgtggttttgatttgcatttccctgattatttgtgttcttgagcatcttttcatgtacttat

SEQ ID NO: 124292 - DNA, 566 bp, Homo sapiens
  Payload ID: 4406
  Gene Symbol: COX6C
  Gene Name: cytochrome c oxidase subunit VIc
  Uniprot ID: P09669
  ENST ID: ENST00000520517
  CDS Start-End: 101-328
attctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacaccagcccaagaaaaaaggagaaaaatctttcctccacataaatcatctattcaacattaaactcagcactgaaataaaagctctgtttgcctagctc

SEQ ID NO: 124293 - DNA, 762 bp, Homo sapiens
  Payload ID: 4407
  Gene Symbol: COX7A1
  Gene Name: cytochrome c oxidase subunit VIIa polypeptide 1 (muscle)
  Uniprot ID: P24310
  ENST ID: ENST00000292907
  CDS Start-End: 463-702
gttacagatacggaaacaggctcggaggtgcaatctctggctgtgtagacagaacagggagttggaacacggccttatgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 124294 - DNA, 211 bp, Homo sapiens
  Payload ID: 4407
  Gene Symbol: COX7A1
  Gene Name: cytochrome c oxidase subunit VIIa polypeptide 1 (muscle)
  ENST ID: ENST00000589154
  CDS Start-End: 30-211
gtgactccggcggaagaggacaaggcagaatgcaggcccttcgggtgtcccaggcgctgatccgctccttcagctccaccgcccggaaccgctttcagaaccgagaggacaatgacatcccgttgtacctgaagggcggcatcgttgacaacatcctgtaccgagtgacaatgacgctgtgtctgggcggcactgtctacagcttgtactc

SEQ ID NO: 124295 - DNA, 407 bp, Homo sapiens
  Payload ID: 4407
  Gene Symbol: COX7A1
  Gene Name: cytochrome c oxidase subunit VIIa polypeptide 1 (muscle)
  ENST ID: ENST00000437291
  CDS Start-End: 276-347
ttaggccccccagaacaaagtccttctgggtcctctcccttccaggaccctctaggcagcccggtcacccccaggccagactccagggcgagtcccctcccaacccagctggcagttcgcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 124296 - DNA, 914 bp, Homo sapiens
  Payload ID: 4408
  Gene Symbol: COX7A2
  Gene Name: cytochrome c oxidase subunit VIIa polypeptide 2 (liver)
  ENST ID: ENST00000370081
  CDS Start-End: 312-659
aagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttgtgaaagcaa

SEQ ID NO: 124297 - DNA, 773 bp, Homo sapiens
  Payload ID: 4408
  Gene Symbol: COX7A2
  Gene Name: cytochrome c oxidase subunit VIIa polypeptide 2 (liver)
  ENST ID: ENST00000370089
  CDS Start-End: 180-527
cagccttagctccagggaccagcctactgaacatcgaaaaggtcaggaacgagatcacgggactgagacggcgagccggctagagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttg

SEQ ID NO: 124298 - DNA, 366 bp, Homo sapiens
  Payload ID: 4408
  Gene Symbol: COX7A2
  Gene Name: cytochrome c oxidase subunit VIIa polypeptide 2 (liver)
  ENST ID: ENST00000377978
  CDS Start-End: 57-366
ggccattttcgttggtggtgttcagttgtggcggttgctggtcagtaacagccaagatgctgcggaatctgctgtttcacacttgttgcccaggctggagtgcaatggcgcgatctcagctcactgcaacctccgcctcccaggttcaagctattctcctgcctcagcctcccaagtatctgggattacaggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtg

SEQ ID NO: 124299 - DNA, 501 bp, Homo sapiens
  Payload ID: 4408
  Gene Symbol: COX7A2
  Gene Name: cytochrome c oxidase subunit VIIa polypeptide 2 (liver)
  ENST ID: ENST00000459637
  CDS Start-End: 1-203
cattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggtactgaagtattttataggagatgttacttgtaattattagattaccaaaaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 124300 - DNA, 357 bp, Homo sapiens
  Payload ID: 4408
  Gene Symbol: COX7A2
  Gene Name: cytochrome c oxidase subunit VIIa polypeptide 2 (liver)
  ENST ID: ENST00000460985
  CDS Start-End: 55-216
ccattttcgttggtggtgttcagttgtggcggttgctggtcagtaacagccaagatgctgcggaatctgctggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttacca

SEQ ID NO: 124301 - DNA, 325 bp, Homo sapiens
  Payload ID: 4408
  Gene Symbol: COX7A2
  Gene Name: cytochrome c oxidase subunit VIIa polypeptide 2 (liver)
  ENST ID: ENST00000472311
  CDS Start-End: 52-282
ttttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgactt

SEQ ID NO: 124302 - DNA, 480 bp, Homo sapiens
  Payload ID: 4408
  Gene Symbol: COX7A2
  Gene Name: cytochrome c oxidase subunit VIIa polypeptide 2 (liver)
  ENST ID: ENST00000509698
  CDS Start-End: 62-337
ggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggtaaggcctttggaatgtttgaaggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatg

SEQ ID NO: 124303 - DNA, 1112 bp, Homo sapiens
  Payload ID: 4409
  Gene Symbol: COX7A2L
  Gene Name: cytochrome c oxidase subunit VIIa polypeptide 2 like
  Uniprot ID: O14548
  ENST ID: ENST00000234301
  CDS Start-End: 56-400
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatg

SEQ ID NO: 124304 - DNA, 3056 bp, Homo sapiens
  Payload ID: 4409
  Gene Symbol: COX7A2L
  Gene Name: cytochrome c oxidase subunit VIIa polypeptide 2 like
  Uniprot ID: O14548
  ENST ID: ENST00000378669
  CDS Start-End: 831-1175
agaatggtaaacacagcagcagagctaccacacacttcccttctgggagcggtggggaaagcagccagggaggtcgggagatggacggaaactgctggggatgtgagaagcctggggcactaactggagttgttattgacttggttgccaggggaagcttggccgacaagtctatactcctgggcagactgagcaacagcaggtggtggcttctggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaattttaagtttgaagttctttgaatgacctttcagagtaatttcagaacaccagcagcatcttaaacctgagtctaatttctttcttgttaattaggcaccagataatctttataaaatggttcttaaaagtctagtaataggagtcttaatggcatattgatgattaccacatggttttttataaaaacctgcctgccccttagtgaaaggtacctgtaactcacagttcatttagacactaatttcctttgctgtcatgattggtagacttcacttaccctatattaattttgaaaaaaggtggaattttattatatatgaaggaatagtttgtatcttaccatagcacagaacagtgacctcttgctcaggataagatgtggtgatttgaaaatactcaatagtagccttgcagtgatatctctctctctctctctctgcaaatctaaattttattctctggtatttcctccaagtttttattttgaaaattttcagactacagaaggactaagcatagtacaatatacacctgtatatccttcacttagatcaccagttatcaatatattggcacctttgctttttcttgttctctcacacaggcacacacaatgcatatatgcacacacacatagatctgttttttgttgagtcatttaagattgttagggaattatgataaatcagccatagtactttagcaggtatcttctgagtaaggacatgtgttcctttataaccataatgcagttgtcagactcaataaagttaacatttataacaatactaccatctaatacatagtttactttcagatttccccaggtgttctaataatgagttcttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagtctctatggatttgtctttcctggacatttcatataaatataatcatatgatgtgtgatgtacgtga

SEQ ID NO: 124305 - DNA, 895 bp, Homo sapiens
  Payload ID: 4409
  Gene Symbol: COX7A2L
  Gene Name: cytochrome c oxidase subunit VIIa polypeptide 2 like
  ENST ID: ENST00000464443
  CDS Start-End: 32-151
agcggatgcgggaagccggactctgggcgtcatgtactacaagtttagtggcttcacgcagaagttggcaggagcatgggcttcggaggcctatagcccgcaggtacgagtggcgcctggccagctcggacatgagaagtggcggccctagcctcggcgacaggcagtcgcggcgttggagccaggggaggcttctgcccgcggtcgagttcgtctctgttctccttgcacctcccggggcctctccacaccagcggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtgg

SEQ ID NO: 124306 - DNA, 516 bp, Homo sapiens
  Payload ID: 4409
  Gene Symbol: COX7A2L
  Gene Name: cytochrome c oxidase subunit VIIa polypeptide 2 like
  ENST ID: ENST00000468711
  CDS Start-End: 1-288
tttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttccagcagggcttcagtgatggtgatacagatgtgcggcactgctgtgtcgtggactcacctcgtcccagactgaggaccaagactgacacagactctcttctgtttcccttatctcctttccaaagtaagtctgtgaatctaccctggtcctttccttctatgtctaatgaatgtctttctcctagtgtagtggaggaagtacaaattttgaagttctagaacataaagtctcagcatggccatga

SEQ ID NO: 124307 - DNA, 540 bp, Homo sapiens
  Payload ID: 4409
  Gene Symbol: COX7A2L
  Gene Name: cytochrome c oxidase subunit VIIa polypeptide 2 like
  ENST ID: ENST00000463055
  CDS Start-End: 12-251
ctctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtgaaataaataggcttaaaaaatcccttatgaaactaaatcttaatctagtttactacccaccctccttctttttctttaagtagtattctcttgattttagtttgagccataaacgaatagaactttatataggtagatactgataaaagaggggagggtggttaatttcctcattagtatttaagggtgtgagggttttgaaatggcatgaatagctcttgatcatttattgcatggaagaagcaatagcctcaataactgagtagcctgtataactgaatgacccaata

SEQ ID NO: 124308 - DNA, 2471 bp, Homo sapiens
  Payload ID: 4410
  Gene Symbol: COX7B
  Gene Name: cytochrome c oxidase subunit VIIb
  Uniprot ID: P24311
  ENST ID: ENST00000481445
  CDS Start-End: 117-359
tcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcattgtaggttttgtttctttgtaaatgaaactaagcttgatcactttagcctttatgttaatattaaagtcaaatgctgtgcagcttcttaaataggtttttttttttttttttttttttttttgggacgaagtctcactttgtcccccaggctggagtgcagtggcaccatctcagctcactgcgacctctgcctcctgagttcaagtgattctcctgtctcagcctcccgagtagccagaactacaggcacatgccatgacgcccagctaattttttttttttttgagacggagtctcactctgttgcccaggctggaatgcaatggcgtgatctcggctcctgcaacctccgcctcccgggttcaagcgattctcctgtctcagccttccaagtagctgggattacaggtgcacgccaccaggcccggctaatttttgtatttttagtagagacggggtttcaccatgttggtcaggctggtctcgagctcctgatctcgtgatccacccaccttggtctcccaaagtgctgggattacaggtgtgagccaccgtgcccggcaatttttgtatttttagtagagacagggtttcaccatattggtcaggctggtttcaaactcacgacctcaggtgatccgcctgccttggcctcccaaagtggtaggattacaggcgtgagccacggcacccagcccttaaatggcttttatgaggtaatgtgaaaggaaaatttgcctttgacctggaagtcaactttatagtaagctgaaattataaataactgatcatggaactattgcagatcacctttgagccaaaaatttggcctggattttggttatgcctactactatgtgcctctcatttgtatttatacctggaattggcattattaactccttttcactcctgcctagaaaacttaaagtgtcaccagacccaagggcggagtggtcctataaaacaaactcgtagcctgtctgaagactagctactagctccttggctgttttggcatattcatcttgattatagctcttggtctttcatcatattagggatgtttatgatgttattaaagaaaatcttgtcaaatgcagtctgttcctagttatctactatcagtcacctgttgtataattataacaatgtttggatttgtggattattattttagtatataacattggattttatgtatgttacctgaagaagagcaatatctgtaccacatatttctttgtttttcttttttgagatgaagtctcactctgttgcccaggctggagtgcagtggtgtgatcttgacacactgcaacctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggcttacaggcatgagacaccgcgcccggcttatatatcattactttcttggctgagagctgtagtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaagtgtcaaccttcaattata

SEQ ID NO: 124309 - DNA, 542 bp, Homo sapiens
  Payload ID: 4411
  Gene Symbol: COX7B2
  Gene Name: cytochrome c oxidase subunit VIIb2
  Uniprot ID: Q8TF08
  ENST ID: ENST00000355591
  CDS Start-End: 177-422
ggctgtaaaacggaaaggttcggaatttgcctctgcgccgtctttttttgcctgttacctgtgacgtccttggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaa

SEQ ID NO: 124310 - DNA, 617 bp, Homo sapiens
  Payload ID: 4411
  Gene Symbol: COX7B2
  Gene Name: cytochrome c oxidase subunit VIIb2
  Uniprot ID: Q8TF08
  ENST ID: ENST00000396533
  CDS Start-End: 252-497
atttgcctctgcgccgtctttttttgcctgttacctgtgacgtccttgaaaatgaaaagctttcttaagacaataggacgggccgggcgcggtggctcatgcctgtaatcctaacactctgggaggccgaggttggcggatcacgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaa

SEQ ID NO: 124311 - DNA, 417 bp, Homo sapiens
  Payload ID: 4411
  Gene Symbol: COX7B2
  Gene Name: cytochrome c oxidase subunit VIIb2
  ENST ID: ENST00000505102
  CDS Start-End: 320-417
tccaggctgtaaaacggaaaggttcggaatttgcctctgcgccgtctttttttgcctgttacctgtgacgtccttgatgattattcttttggctctttacaatgtagctaggaaaaatttgtctttgatgtgatataatatctgaatccctggaggaactacagtcatgcatcgctgaacagcaaggatatatgttctgaaaaatgcatcattaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccaga

SEQ ID NO: 124312 - DNA, 587 bp, Homo sapiens
  Payload ID: 4411
  Gene Symbol: COX7B2
  Gene Name: cytochrome c oxidase subunit VIIb2
  ENST ID: ENST00000543208
  CDS Start-End: 230-472
ctttttttctattcttgttttagaaaatgaaaagctttcttaagacaataggacgggccgggcgcggtggctcatgcctgtaatcctaacactctgggaggccgaggttggcggatcacgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatcttt

SEQ ID NO: 124313 - DNA, 666 bp, Homo sapiens
  Payload ID: 4412
  Gene Symbol: COX7C
  Gene Name: cytochrome c oxidase subunit VIIc
  Uniprot ID: P15954
  ENST ID: ENST00000247655
  CDS Start-End: 153-344
cgcgtttcctcaaggctccgccccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 124314 - DNA, 347 bp, Homo sapiens
  Payload ID: 4412
  Gene Symbol: COX7C
  Gene Name: cytochrome c oxidase subunit VIIc
  ENST ID: ENST00000515763
  CDS Start-End: 84-254
cgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtaatatgaagagcattttaagaggtgcagcctctggaagtggatcaaactagaactcatatgccatactagatatgtttgtcaataaacttatgacgtgaa

SEQ ID NO: 124315 - DNA, 1584 bp, Homo sapiens
  Payload ID: 4412
  Gene Symbol: COX7C
  Gene Name: cytochrome c oxidase subunit VIIc
  Uniprot ID: P15954
  ENST ID: ENST00000509578
  CDS Start-End: 101-292
gcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgac

SEQ ID NO: 124316 - DNA, 507 bp, Homo sapiens
  Payload ID: 4413
  Gene Symbol: COX8A
  Gene Name: cytochrome c oxidase subunit VIIIA (ubiquitous)
  Uniprot ID: P10176
  ENST ID: ENST00000314133
  CDS Start-End: 75-284
ggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgaccctgcttggtggggtcccccttgtaacaataaaatctatttaaacttta

SEQ ID NO: 124317 - DNA, 533 bp, Homo sapiens
  Payload ID: 4414
  Gene Symbol: COX8C
  Gene Name: cytochrome c oxidase subunit VIIIC
  Uniprot ID: Q7Z4L0
  ENST ID: ENST00000342144
  CDS Start-End: 79-297
acgagcactggagcttgcgttacttggcctcacctcacctgtgctgtccacgcctggctttgtctcacctgacgcgatatgcctctcctgcgtgggcgctgtcctgcccgccgccactaccgccgcttggccctgctcggcctgcagcccgctccccgcttcgcccactcggggcccccgcgccagcggcccctgtctgccgcggaaatggctgttggacttgtggtgttttttacgaccttcttaacaccagctgcatatgtgctaggcaacctgaagcagttcagaaggaattagatggaagatgatgttgaacagctgttaacgtccaaaaaactttcagaaaaagctgtgtttttgttaacgagcaaaattgcctagttgagttgatgcaaccattgtggtattcactttcctcatgtttatgatgaatattttgcacttttttagtactgtgcattatatagatgtatagtcaaaaatgttctgcttaagtgttaaataaaacggaaacacttattcgtgcttggtaa

SEQ ID NO: 124318 - DNA, 533 bp, Homo sapiens; identical to SEQ ID NO: 124317
  Payload ID: 4414
  Gene Symbol: COX8C
  Gene Name: cytochrome c oxidase subunit VIIIC
  Uniprot ID: Q7Z4L0
  ENST ID: ENST00000620478
  CDS Start-End: 79-297

SEQ ID NO: 124319 - DNA, 4098 bp, Homo sapiens
  Payload ID: 4415
  Gene Symbol: CYCS
  Gene Name: cytochrome c, somatic
  Uniprot ID: P99999
  ENST ID: ENST00000305786
  CDS Start-End: 171-488
gtagccgccagctcggccgcacgtcagggcgcgggagcgcggagcgagtttggttgcacttacaccggtacttaagcgcggaccggcgtgtccttggacttagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagttaaacttcactcttgaattctttacaatctaagtcaaactaagttataatttaggattgtctttaaacagccattcagaaacaaaactgtagaactgtgtatttgattgggaatggtgcttttgccaacttaaaaggattaaagtaacggagatatacacaaattttaaaattatgtgtgatcacaagactaaagataattaaaaagaaaaccacagatcatgactttttgactgtgcttgatttcatgactgatgcacaaattttaatgattaaaaagtgcaggagccctaaatgtcagtgcagcagccctaaatgtcagtgcagcagtgttaaccagtcatggtgctagattgtttacttggttttctaggactgcctcaactagaataacacttcactaattgactcttagtttctttgctcagattgagaactgcagcatttatgccagacatggacagaggaatgcctgtggtcatagttttgtgatgtgtaacagtgtataattacatactgaattatttcatgcatagtctgtgccatacacatttagagtagtccttggagattttatggagatggtgagcacaaggtaagtcataaagaataatgagaaaataaatctatgctggtgcagctgagaactgtatctttgtgggacagtgagaagactgagaagatgtgaatccatggtctcaaaggtgatagggacgattagataggtgttttaaggcctgaaagcaatttataacatatgagtcttatttttatttatagaaatgtggaaagcttgctgtaattcatatttgaagtcctagtctgagttctggtggggaatttaaaaatgcatcctggaaatcctttaaagatttcagactttgaaaggccttgtagcagaggacttggtgactgtataaagttagtggtattcagggacagtgtagcaagtagcttacaaggggacaattctggactaatgagaaagacctgaagtgaaggctagagagttgattttttttttttttggcatcctggaaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcccaggctcaagcgattctctcacttcagcttcccaagtagctgggactacaggtgttcgccaccatgcccagctaatttttttgtagagatggagttttgccatgtggtcccaggctggtctcaaactcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggtgcaatctcactgcaacctccgccttccagttgcaagtgattctcctgcctcagcctcctgagtagctgggattacaggcacccgccaccacgcctggctaatttttgtatttttagtggagatggtgtttcaccatgttggccagactggtcttggactcctgacctcgtgatccacccaccttggcctcccaaagttctaggattacaggtgtgagccaccacgtccggccaatttttctcatttctatgcctcctatattaaggtctgtgttggcacagatgagtaactgccatgttctaggtcagttatacccaagcacttctggtggtttaaaatgtgattctgtaacttttttatttttatttttttgagataatttcactcttgttgcccaggctggagtgcaatggcgtgatcgctgctcaccgcaacctccgccttccaggttcaagcgattctcctgactcagcctctcaagtagctgggattacaagcatgcgccaccatgcccagcttattttgtgtttttagtagagacagggtttctccatgctggacaggctggtcttgaactcccgacgtcaggtgatctacctgcctcggcctcccaaagtgctgggattacaggcgtgagccaccacgcctggccaattatgtaattttttaaaaaggacatttctatcagggatatataccttcagaaataaggaaataggggaaaaaaagagcactataaaccacatgttttcatttctagtgcttcgctgtaagtggctaggttggtagaatcaaaaacaagggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaa

SEQ ID NO: 124320 - DNA, 974 bp, Homo sapiens
  Payload ID: 4415
  Gene Symbol: CYCS
  Gene Name: cytochrome c, somatic
  Uniprot ID: P99999
  ENST ID: ENST00000409409
  CDS Start-End: 263-580
acgtccggcttcggagcgggagtgttcgttgtgccagcgactaaaaagaggtgagagcgggtcgcggaggccgcacctggttagaggcagagctgtgggaggcgcgcacttgcgagcgaccgaaacccaagcggggagcattcgagtggagcccgcgctgggtgggagggcggggagtgaagaccctggactgtggtcagaccgagctgggcgagtaacggcttgaggtgcggcggagccctaactagggacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaac

SEQ ID NO: 124321 - DNA, 799 bp, Homo sapiens
  Payload ID: 4415
  Gene Symbol: CYCS
  Gene Name: cytochrome c, somatic
  Uniprot ID: P99999
  ENST ID: ENST00000409764
  CDS Start-End: 225-542
agagagtggggacgtccggcttcggagcgggagtgttcgttgtgccagcgactaaaaagagagggcaaaagctgttgctcttctaataaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaattttaatagtaactccaattcagtaaatggtatcactgtttaccccttttaaagatatgattagacttcgt

SEQ ID NO: 124322 - DNA, 498 bp, Homo sapiens
  Payload ID: 4415
  Gene Symbol: CYCS
  Gene Name: cytochrome c, somatic
  ENST ID: ENST00000413447
  CDS Start-End: 196-498
agagagtggggacgtccggcttcggagcgggagtgttcgttgtgccagcgactaaaaagaggggccagttcttttcgtgggcacatgtttcttccgtcagtcgttctgacatcctagaaggagtttcatcaatcaccttgaaaccgacctggacgggtgacctcgtggtcgccccaggagatcacagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaa

SEQ ID NO: 124323 - DNA, 1240 bp, Homo sapiens
  Payload ID: 4416
  Gene Symbol: CYC1
  Gene Name: cytochrome c-1
  Uniprot ID: P08574
  ENST ID: ENST00000318911
  CDS Start-End: 74-1051
gctttcgcgaggttttgactctcgtggcgccccaggggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcgtcccgggcagctcccgctacggacacctcaggcagtggccttgtcgtcgaagtctggcctttcccgaggccggaaagtgatgctgtcagcgctgggcatgctggcggcagggggtgcggggctggccatggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgta

SEQ ID NO: 124324 - DNA, 2685 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000379727
  CDS Start-End: 200-1738
atctcagctcgctccagggaaggaggcgtggccacacgtacaagcccgcctataaaggtggcagtgccttcaccctcaccctgaaggtgacagttccttggaaccttccctgatccttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 124325 - DNA, 2608 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000395048
  CDS Start-End: 123-1661
ctcaccctgaaggtgacagttccttggaaccttccctgatccttgtgatcccaggctccaagagtccacccttcccagctcagctcagtacctcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 124326 - DNA, 1594 bp, Homo sapiens
  Payload ID: 4417
  Gene Symbol: CYP1A1
  Gene Name: cytochrome P450, family 1, subfamily A, polypeptide 1
  ENST ID: ENST00000395049
  CDS Start-End: 84-1535
ttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagacc

SEQ ID NO: 124327 - DNA, 1544 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000569630
  CDS Start-End: 78-647
tgatcccaggctccaagagtccacccttcccagctcagctcagtacctcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggacctgaatgagaagttctacagcttcatgcagaagatggtcaaggagcactacaaaacctttgagaagacagcaatagccactgaagagtcattacatgcaggaccctggggcagttgctgagggagccaggaagagttaaagagttcatctcctggcctcataatagaaagaagataaagagcacatccagatgataacagtacaagacgctgtgtgtcaaatgtcccatgagttggggctagcagcattctaaggtagtaggagagagccttgcagaggcagagagaagctgggacaacagcctcagggggcatcacctccagaacaaatgtgctaggaatagtgaaggaccagacctggatggagaggtagctctgggtttgagatcttgctcacctgtggactttccctacctaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgat

SEQ ID NO: 124328 - DNA, 1192 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000562201
  CDS Start-End: 78-647
tgatcccaggctccaagagtccacccttcccagctcagctcagtacctcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgat

SEQ ID NO: 124329 - DNA, 796 bp, Homo sapiens
  Payload ID: 4417
  Gene Symbol: CYP1A1
  Gene Name: cytochrome P450, family 1, subfamily A, polypeptide 1
  ENST ID: ENST00000566503
  CDS Start-End: 272-796
tgatcccaggctccaagagtccacccttcccagctcagctcagtacctcaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgat

SEQ ID NO: 124330 - DNA, 2107 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000567032
  CDS Start-End: 236-1774
cttcttaggtagctacctgtctagcacctccaaaaagggaggctcagagtgtttttagtgaccaggcagtctagccccctagtggggaaactgaggccaggggaagaggaggacttgcccatggtcccacagctggtaccagacctctagatacagatggcatctcattcaggacttcaggacccaggctccagctccatcccctacagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctg

SEQ ID NO: 124331 - DNA, 988 bp, Homo sapiens
  Payload ID: 4417
  Gene Symbol: CYP1A1
  Gene Name: cytochrome P450, family 1, subfamily A, polypeptide 1
  Uniprot ID: P04798
  ENST ID: ENST00000564596
  CDS Start-End: 272-745
tgatcccaggctccaagagtccacccttcccagctcagctcagtacctcaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagtaagttcagagatgcagaggaaaggctgggtccaccctcttaagctcttatatatgattaatacaatcattgcattgatcctcctgtccatgggctgcttgcctgtcctctatcctttggggctggagctccactcacttgacacttctgagccctgaactgccacttcagctgtctccctctggttacaggaagctatgggtcaacccatctgagttcctacctgaacggtttctcacccctgat

SEQ ID NO: 124332 - DNA, 2402 bp, Homo sapiens
  Payload ID: 4417
  Gene Symbol: CYP1A1
  Gene Name: cytochrome P450, family 1, subfamily A, polypeptide 1
  ENST ID: ENST00000612821
  CDS Start-End: 1-1455
atgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 124333 - DNA, 2521 bp, Homo sapiens
  Payload ID: 4417
  Gene Symbol: CYP1A1
  Gene Name: cytochrome P450, family 1, subfamily A, polypeptide 1
  ENST ID: ENST00000617691
  CDS Start-End: 123-1574
ctcaccctgaaggtgacagttccttggaaccttccctgatccttgtgatcccaggctccaagagtccacccttcccagctcagctcagtacctcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 124334 - DNA, 2728 bp, Homo sapiens
  Payload ID: 4418
  Gene Symbol: CYP1A2
  Gene Name: cytochrome P450, family 1, subfamily A, polypeptide 2
  Uniprot ID: P05177
  ENST ID: ENST00000343932
  CDS Start-End: 64-1614
aagctccacaccagccattacaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagaacagtgtccgggacatcacgggtgccctgttcaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctc

SEQ ID NO: 124335 - DNA, 5250 bp, Homo sapiens
  Payload ID: 4419
  Gene Symbol: CYP1B1
  Gene Name: cytochrome P450, family 1, subfamily B, polypeptide 1
  Uniprot ID: Q16678
  ENST ID: ENST00000610745
  CDS Start-End: 404-2035
aaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtataatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaaggaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaaca

SEQ ID NO: 124336 - DNA, 567 bp, Homo sapiens
  Payload ID: 4419
  Gene Symbol: CYP1B1
  Gene Name: cytochrome P450, family 1, subfamily B, polypeptide 1
  ENST ID: ENST00000490576
  CDS Start-End: 138-567
tttgactctggagtgggagtgggagcgagcgcttctgcgactccagttgtgagagccgcaagggcatgggaattgacgccactcaccgacccccagtctcaatctcaacgctgtgaggaaacctcgactttgccagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgc

SEQ ID NO: 124337 - DNA, 1479 bp, Homo sapiens
  Payload ID: 4419
  Gene Symbol: CYP1B1
  Gene Name: cytochrome P450, family 1, subfamily B, polypeptide 1
  ENST ID: ENST00000494864
  CDS Start-End: 305-823
ggcttttacaaagagatcaacaatagaacaggagaaattctaccagatgcaaaaagaaaagggcaagggagaatataaacgtttgcctaattcactgatctgcttaaactgccttttaatgcttagaaaatagaaaggatggcacgatcctttgatgaaaggaggctgtttatgtcagaagaagtccagacctctcacagtgacgaggggagaataaaaaagctgcaacatcaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagcagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaa

SEQ ID NO: 124338 - DNA, 2174 bp, Homo sapiens
  Payload ID: 4419
  Gene Symbol: CYP1B1
  Gene Name: cytochrome P450, family 1, subfamily B, polypeptide 1
  Uniprot ID: Q16678
  ENST ID: ENST00000614273
  CDS Start-End: 303-1934
ccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcaggtcacatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaatt

SEQ ID NO: 124339 - DNA, 1934 bp, Homo sapiens
  Payload ID: 4420
  Gene Symbol: CYP11A1
  Gene Name: cytochrome P450, family 11, subfamily A, polypeptide 1
  Uniprot ID: P05108
  ENST ID: ENST00000268053
  CDS Start-End: 156-1721
agcctgcagcaggaggaaggacgtgaacattttatcagcttctggtatggccttgagctggtagttataatcttggccctggtggcccagggctacagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtgg

SEQ ID NO: 124340 - DNA, 2001 bp, Homo sapiens
  Payload ID: 4420
  Gene Symbol: CYP11A1
  Gene Name: cytochrome P450, family 11, subfamily A, polypeptide 1
  Uniprot ID: P05108
  ENST ID: ENST00000358632
  CDS Start-End: 697-1788
gacagacccagcattcctcccagcgcacgccgccgcccgggccgcgctattccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggtcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttctgcccagcctgctcagcaggttgaatgggttctcagtggtcaccttcctcagctcagctgggccactcctcttcacccaccccatggagacaataaacagctgaaccatgtgg

SEQ ID NO: 124341 - DNA, 566 bp, Homo sapiens
  Payload ID: 4420
  Gene Symbol: CYP11A1
  Gene Name: cytochrome P450, family 11, subfamily A, polypeptide 1
  ENST ID: ENST00000416978
  CDS Start-End: 62-566
acagtcatcctagcagtccccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagcctggggtctgtgaccatgagggcttgtgggcccatgttttctcaggaagtcggcagcctggaagaaagaccgggtggc

SEQ ID NO: 124342 - DNA, 1629 bp, Homo sapiens
  Payload ID: 4420
  Gene Symbol: CYP11A1
  Gene Name: cytochrome P450, family 11, subfamily A, polypeptide 1
  ENST ID: ENST00000435365
  CDS Start-End: 43-1287
ccgctgaagtggagcaggtacagtcacagctgtggggacagcatgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaatatgctggagaacttcagagttgaaatccaacacctcagcgatgtgggcaccacattcaacctcattctgatgcctgaaaagcccatctccttcaccttctggccctttaaccaggaagcaacccagcagtgatcagagaggatggcctgcagccacatgggaggaaggcccaggggtggggcccatggggtctctgcatcttcagtcgtctgtcccaagtcctgctcctttc

SEQ ID NO: 124343 - DNA, 1045 bp, Homo sapiens
  Payload ID: 4420
  Gene Symbol: CYP11A1
  Gene Name: cytochrome P450, family 11, subfamily A, polypeptide 1
  ENST ID: ENST00000450547
  CDS Start-End: 758-1045
gccgccgcccgggccgcgctattccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggtcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaagagcaatttagaaaatacagagaaacacaaatgaaaaattgaagtcagatacaatcaattccaattgatttaacatttaagtatcatgagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctg

SEQ ID NO: 124344 - DNA, 572 bp, Homo sapiens
  Payload ID: 4420
  Gene Symbol: CYP11A1
  Gene Name: cytochrome P450, family 11, subfamily A, polypeptide 1
  ENST ID: ENST00000569662
  CDS Start-End: 493-572
attccgaaattgggtccgccctagcgtggcccccggcctgctcctgcgctcttcgcgggtcgctcacctccgcctcccctcgacacagcccgagcccatccgccccccgggtcgacccgcgtttacctcagggcgaggtccaggcgctcggccccgcggaggcggcggcggccccaccgcaggtcctaggtcccagtcactctgccgccaagttccccaacacggactccgtgcgctttgaggtgttacgggggcgctggagcactggcttcgctggccctgccaggaggcggcggcgaagcagggagcgacccggtatgcgtttctctgcccggcctgcggccctgcagcatccactcctcgcctctgctggcctctgccctcgctcgctgcgttcacccgagctcacccgagcccaccggagccgacagtggcgcgctaaggaagtcggcagcctggaagaaagaccgggtggccctgaaccaggaggtgatggctccagaggccaccaagaactttttgcccctgttggatgcagtgtctcgggacttcgtcagtgtcctgcacaggcg

SEQ ID NO: 124345 - DNA, 969 bp, Homo sapiens
  Payload ID: 4420
  Gene Symbol: CYP11A1
  Gene Name: cytochrome P450, family 11, subfamily A, polypeptide 1
  ENST ID: ENST00000566674
  CDS Start-End: 287-969
ggcaggcacgggcaggggacacaaggtgctcagtgggggagcttttgagccaggatgagccaggagaaggaatttcacaagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaag

SEQ ID NO: 124346 - DNA, 2664 bp, Homo sapiens
  Payload ID: 4421
  Gene Symbol: CYP11B1
  Gene Name: cytochrome P450, family 11, subfamily B, polypeptide 1
  Uniprot ID: P15538
  ENST ID: ENST00000292427
  CDS Start-End: 34-1545
attgcagctgaacagggtggagggagcattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggtgttgggtcctctgcttcctgtgctgtcccctggggaaggtcccgaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcccgtgcagggagaggaagcacccagtttgagagtgtacccagccagactgtctttatctccatggattttcatcagggcaaagatcacagcagccagctcc

SEQ ID NO: 124347 - DNA, 2280 bp, Homo sapiens
  Payload ID: 4421
  Gene Symbol: CYP11B1
  Gene Name: cytochrome P450, family 11, subfamily B, polypeptide 1
  ENST ID: ENST00000377675
  CDS Start-End: 8-1732
cattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtcccggcactctgcatcctttggaagatggggaaggagtgcagcacgtgctggtctgtggcgctgccagggcaggggatggtgcagagcaaatcccagctcgctgcagagagggcaggactcagaggcactgaagtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctaaatgtggctgacaggggaaattcctccccaccattccctgggggcatccatggagcccccacgcactctggctgtaggaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaa

SEQ ID NO: 124348 - DNA, 1874 bp, Homo sapiens
  Payload ID: 4421
  Gene Symbol: CYP11B1
  Gene Name: cytochrome P450, family 11, subfamily B, polypeptide 1
  Uniprot ID: P15538
  ENST ID: ENST00000517471
  CDS Start-End: 12-1325
ggagcattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctggggtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaa

SEQ ID NO: 124349 - DNA, 2562 bp, Homo sapiens
  Payload ID: 4421
  Gene Symbol: CYP11B1
  Gene Name: cytochrome P450, family 11, subfamily B, polypeptide 1
  ENST ID: ENST00000519285
  CDS Start-End: 1-546
gccgccgcagccagcatcagtgaacatccccagaaggcaaccaccgagctgcccttgctgcgtgcggccctcaaggagaccttgcggaagggtgcagagagcacaggaagccccatccagctgaggaccctttctatggatgcccccacctccaggctctaccctgtgggtctgtttctggagcgagtggcgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggtgttgggtcctctgcttcctgtgctgtcccctggggaaggtcccgaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcccgtgcagggagaggaagcacccagtttgagagtgtacccagccagactgtctttatctccatggattttcatcagggcaaagatcacagcagccagctcctggtggctgatgaggatcagagcatttgttcccccatgaaaggggaaatccctatggcatcattccagtggtggtcagtagatccaggacgccctgcaggactcagcctgtacagggagatgaagtgccccaggttgggagcacacctagctagagttatttgtgttaatctattcaggatgctctaagaaaacgccatagactgggttgctgacaaacatcagaattctatttctcatggttctgaaggcttagaaggctaagatcaaggtgtcagcaggttctgtgtctggtgaggacccacctcttgtttcatagataaaaccttcttgctgtgtcctcacatggtggaaaagggcaagacagctcacagagacctcttttataaggacgccagttccattcaagagggcactgcctgcattcccttcccccctcaaaggcccggccctgctattatcgtcaccttggtgactagatttcagcctatgaattctggaggcggacacaaaaattcagattaaactactctgcttctgtttctctaaaatctacatccttctcatatacaaaatacatgcatttctccccagtagccccaaatatcaactcattttagcatcaactttaaaattgtagtccaaagtgtgatttaaatgttatctgagtcaaacatgggtaagactcaaggtacaatttatcctgagtccaactgttcttgctgcgaacctatgaaatcaaacatgttatgtgcttccaaaatacagtggttggagaggcataggataaacattcccattccagaaaggagaaacaggaaagaagaaaggagtaacaagtttcaagcaactccaaaattgaatgtgacaaacagtattaaaccttaagcctcaagaa

SEQ ID NO: 124350 - DNA, 2936 bp, Homo sapiens
  Payload ID: 4422
  Gene Symbol: CYP11B2
  Gene Name: cytochrome P450, family 11, subfamily B, polypeptide 2
  Uniprot ID: P19099
  ENST ID: ENST00000323110
  CDS Start-End: 4-1515
ggaatggcactcagggcaaaggcagaggtgtgcgtggcagcgccctggctgtccctgcaaagggcacgggcactgggcactagagccgctcgggcccctaggacggtgctgccgtttgaagccatgccccagcatccaggcaacaggtggctgaggctgctgcagatctggagggagcagggttatgagcacctgcacctggagatgcaccagaccttccaggagctggggcccattttcaggtacaacttgggaggaccacgcatggtgtgtgtgatgctgccggaggatgtggagaagctgcaacaggtggacagcctgcatccctgcaggatgatcctggagccctgggtggcctacagacaacatcgtgggcacaaatgtggcgtgttcttgttgaatgggcctgaatggcgcttcaaccgattgcggctgaacccagatgtgctgtcgcccaaggccgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttagctctttttggagagcggctgggcctggttggccacagccccagttctgccagcctgaacttcctccatgccctggaggtcatgttcaaatccaccgtccagctcatgttcatgcccaggagcctgtctcgctggatcagccccaaggtgtggaaggagcactttgaggcctgggactgcatcttccagtacggtgacaactgtatccagaaaatctaccaggaactggccttcaaccgccctcaacactacacaggcatcgtggcggagctcctgttgaaggcggaactgtcactagaagccatcaaggccaactctatggaactcactgcagggagcgtggacacgacagcgtttcccttgctgatgacgctctttgagctggctcggaaccccgacgtgcagcagatcctgcgccaggagagcctggccgccgcagccagcatcagtgaacatccccagaaggcaaccaccgagctgcccttgctgcgggcggccctcaaggagaccttgcggctctaccctgtgggtctgtttttggagcgagtggtgagctcagacttggtgcttcagaactaccacatcccagctgggacattggtacaggttttcctctactcgctgggtcgcaatgccgccttgttcccgaggcctgagcggtataatccccagcgctggctagacatcaggggctccggcaggaacttccaccacgtgccctttggctttggcatgcgccagtgcctcgggcggcgcctggcagaggcagagatgctgctgctgctgcaccacgtgctgaagcacttcctggtggagacactaactcaagaggacataaagatggtctacagcttcatattgaggcctggcacgtcccccctcctcactttcagagcgattaactagtcttgcatctgcacccagggtcccagcctggccaccagcttccctctgcctgaccccaggccacctgtcttctctcccacgtgcacagcttcctgagtcacccctctgtccagccagctcctgcacaaatggaactccccagggcctccaggactggggcttgccaggcttgtcaaatagcaaggccagggcacagctggagacgatcttgctggcagggcctggccttgtccccagctccacctggccccttctccagcaagcagtgccctctggacagcttgactctactcccagcgctggctccaggctcctcatgaggccatgcaagggtgctgtgattttgtcccttgccttcctgcctagtctcacatgtccctgtccctctcgccctggccagggcctctgtgcagacagtgtcagagtcattaagcgggatcccagcatctcagagtccagtcaagttccctcctgcagcctgaccccaggcagctcgagcatgccctgagctctctgaaagttgtcaccctggaatacgatcctgcagggtagactaaaaaggcccctgtggtcacttatcctgacacattttcaagtgatacaactgagtctcgaggggcgtgtgttccccagctgatcatgtcagcctcatgccccaggcctcgtctttcatggaccaggtcttgttcaagcagcgagtgttgggtcctctgcttcctgagctgtcccctggagaaggtcccgaggatgctgtcaggagatggaagagtcatgtggggtgggaacctggggtgtggttccagaaatgtttttggcaacaggagagacaggattgggccaacaaggactcagatgagttttattgactcattcctctggttgatacggagccatgtcatgtgccacgacctggggtgggcacagggaggctgcagttccctacgtgaacctgccttgggcctcatctgctcctagcccagcagagagagttgacccctcctgaactggccactccccagtgctcctgtgcagggataggaagtgccccagggtgagaacgtgcccagccacatcatctttatctcctgggattttcattagggcaaagatctcagcagccagctcctggtagctgatgaggatcagagcgtttgttcccccatgaaaggggaaatacttaggtaatcattccaggtgtgttcagtagttccaggactcagggactcaggccagtcaccctgtgaccgcaggttgctttcccaccctgggcaatgcagtgcagcatgggaaaggaataagggggcaacaaggtgcacagacctcagagatggcttccttgtttatggggctctcacagatacccatccaactcctctagtcagcactagatcatgggatcctaaaataaaccttggaaaaat

SEQ ID NO: 124351 - DNA, 1870 bp, Homo sapiens
  Payload ID: 4423
  Gene Symbol: CYP17A1
  Gene Name: cytochrome P450, family 17, subfamily A, polypeptide 1
  Uniprot ID: P05093
  ENST ID: ENST00000369887
  CDS Start-End: 173-1699
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 124352 - DNA, 4409 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000260433
  CDS Start-End: 148-1659
gcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggacaggaagaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagt

SEQ ID NO: 124353 - DNA, 4417 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000396402
  CDS Start-End: 155-1666
ggacagggttcagggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggacaggaagaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagta

SEQ ID NO: 124354 - DNA, 2388 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000396404
  CDS Start-End: 250-1761
gagtttctggagggctgaacacgtggaggcaaacaggaaggtgaagaagaacttatcctatcaggacggaaggtcctgtgctcgggatcttccagacgtcgcgcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttc

SEQ ID NO: 124355 - DNA, 1697 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000405913
  CDS Start-End: 100-756
ggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccagttgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttccgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgaccaaacacctgacaggaatggaattcactggacttgtatctaattgttttacactgttttctatgggttacattttttattgccattgtgacctttatccacacactaacctggaaagtataggaataaaagaattggcattctttctgataca

SEQ ID NO: 124356 - DNA, 794 bp, Homo sapiens
  Payload ID: 4424
  Gene Symbol: CYP19A1
  Gene Name: cytochrome P450, family 19, subfamily A, polypeptide 1
  ENST ID: ENST00000405011
  CDS Start-End: 297-794
ggagtttctggagggctgaacacgtggaggcaaacaggaaggtgaagaagaacttatcctatcaggacggaaggtcctgtgctcgggatcttccagacgtcgccaactgatctcttagcaacaagaagcacctttataaaagatggcacacgaagagtgattgccagaaaagccacctggttcttaaacagccgcgcatcattagcaaaactcaccatcttcaagagtccaaaaactagaagtgaccagcagacccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaa

SEQ ID NO: 124357 - DNA, 1442 bp, Homo sapiens
  Payload ID: 4424
  Gene Symbol: CYP19A1
  Gene Name: cytochrome P450, family 19, subfamily A, polypeptide 1
  ENST ID: ENST00000439712
  CDS Start-End: 387-1442
gggagtttctggagggctgaacacgtggaggcaaacaggaaggtgaagaagaacttatcctatcaggacggaaggtcctgtgctcgggatcttccagacgtcgccatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaa

SEQ ID NO: 124358 - DNA, 1062 bp, Homo sapiens
  Payload ID: 4424
  Gene Symbol: CYP19A1
  Gene Name: cytochrome P450, family 19, subfamily A, polypeptide 1
  ENST ID: ENST00000453807
  CDS Start-End: 337-1062
tcagggagtttctggagggctgaacacgtggaggcaaacaggaaggtgaagaagaacttatcctatcaggacggaaggtcctgtgctcgggatcttccagacgtcgcgaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaa

SEQ ID NO: 124359 - DNA, 832 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000557858
  CDS Start-End: 120-776
cgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcac

SEQ ID NO: 124360 - DNA, 458 bp, Homo sapiens
  Payload ID: 4424
  Gene Symbol: CYP19A1
  Gene Name: cytochrome P450, family 19, subfamily A, polypeptide 1
  ENST ID: ENST00000559653
  CDS Start-End: 1-415
tgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgtaagagcccttccttaaaactgagtgtgccactcttgaaaatgtcaactgttaaatcctc

SEQ ID NO: 124361 - DNA, 993 bp, Homo sapiens
  Payload ID: 4424
  Gene Symbol: CYP19A1
  Gene Name: cytochrome P450, family 19, subfamily A, polypeptide 1
  ENST ID: ENST00000559980
  CDS Start-End: 478-993
gggagtttctggagggctgaacacgtggaggcaaacaggaaggtgaagaagaacttatcctatcaggacggaaggtcctgtgctcgggatcttccagacgtcgcactccactgtcagatccctctccaactcttcctgtgtgggatgatggcatttttcacagaagaagggggacatgttgatatggcctacaagcatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctg

SEQ ID NO: 124362 - DNA, 1958 bp, Homo sapiens
  Payload ID: 4424
  Gene Symbol: CYP19A1
  Gene Name: cytochrome P450, family 19, subfamily A, polypeptide 1
  Uniprot ID: P11511
  ENST ID: ENST00000559878
  CDS Start-End: 153-1664
acattataaaacagtaagtgaatctgtactgtacagcaccctctgaagcaacaggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaag

SEQ ID NO: 124363 - DNA, 1032 bp, Homo sapiens
  Payload ID: 4424
  Gene Symbol: CYP19A1
  Gene Name: cytochrome P450, family 19, subfamily A, polypeptide 1
  ENST ID: ENST00000558328
  CDS Start-End: 183-1032
gaacacgtggaggcaaacaggaaggtgaagaagaacttatcctatcaggacggaaggtcctgtgctcgggatcttccagacgtcgcgtatgtatctcttaatctgactgagccctcaacctgtgggatcagacactctttccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattt

SEQ ID NO: 124364 - DNA, 592 bp, Homo sapiens
  Payload ID: 4424
  Gene Symbol: CYP19A1
  Gene Name: cytochrome P450, family 19, subfamily A, polypeptide 1
  ENST ID: ENST00000559646
  CDS Start-End: 99-592
gaacgtgaccaactggagcctgacaggaggtccctggcactggtcagcccatcaaaccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgc

SEQ ID NO: 124365 - DNA, 1196 bp, Homo sapiens
  Payload ID: 4424
  Gene Symbol: CYP19A1
  Gene Name: cytochrome P450, family 19, subfamily A, polypeptide 1
  ENST ID: ENST00000557934
  CDS Start-End: 141-1196
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaa

SEQ ID NO: 124366 - DNA, 872 bp, Homo sapiens
  Payload ID: 4424
  Gene Symbol: CYP19A1
  Gene Name: cytochrome P450, family 19, subfamily A, polypeptide 1
  ENST ID: ENST00000561075
  CDS Start-End: 141-872
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatg

SEQ ID NO: 124367 - DNA, 123 bp, Homo sapiens
  Payload ID: 4424
  Gene Symbol: CYP19A1
  Gene Name: cytochrome P450, family 19, subfamily A, polypeptide 1
  ENST ID: ENST00000613097
  CDS Start-End: 1-123
aagtctgtggtaatacaactttggaagatttatgagtacaattggattggtttttttcccttgtgtctttgctgtttttcttggcctctcagcaaggatttgaaagatgccatagaagttctg

SEQ ID NO: 124368 - DNA, 1739 bp, Homo sapiens
  Payload ID: 4425
  Gene Symbol: CYP2A13
  Gene Name: cytochrome P450, family 2, subfamily A, polypeptide 13
  Uniprot ID: Q16696
  ENST ID: ENST00000330436
  CDS Start-End: 1-1485
atgctggcctcagggctgcttctggtgaccttgctggcctgcctgactgtgatggtcttgatgtcagtctggcggcagaggaagagcagggggaagctgcctccgggacccaccccattgcccttcattggaaactacctgcagctgaacacagagcagatgtacaactccctcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggcgtggcgttcagcaacggggagcgcgccaagcagctccggcgcttctccatcgccaccctaaggggttttggcgtgggcaagcgcggcatcgaggaacgcatccaggaggaggcgggcttcctcatcgacgccctccggggcacgcacggcgccaatatcgatcccaccttcttcctgagccgcacagtctccaatgtcatcagctccattgtctttggggaccgctttgactatgaggacaaagagttcctgtcactgttgcgcatgatgctgggaagcttccagttcacggcaacctccacggggcagctctatgagatgttctcttcggtgatgaaacacctgccaggaccacagcaacaggcctttaaggagctgcaagggctggaggacttcatcgccaagaaggtggagcacaaccagcgcacgctggatcccaattccccacgggacttcatcgactcctttctcatccgcatgcaggaggaggagaagaaccccaacacagagttctacttgaagaacctggtgatgaccaccctgaacctcttctttgcgggcactgagaccgtgagcaccaccctgcgctacggtttcctgctgctcatgaagcacccagaggtggaggccaaggtccatgaggagattgacagagtgatcggcaagaaccggcagcccaagtttgaggaccgggccaagatgccctacacagaggcagtgatccacgagatccaaagatttggagacatgctccccatgggtttggcccacagggtcaacaaggacaccaagtttcgggatttcttcctccctaagggcactgaagtgttccctatgctgggctccgtgctgagagaccccaggttcttctccaacccccgggacttcaatccccagcacttcctggataagaaggggcagtttaagaagagtgatgcttttgtgcccttttccatcggaaagcggtactgttttggagaaggcctggccagaatggagctctttctcttcttcaccaccatcatgcagaactttcgcttcaagtcccctcagtcgcctaaggatatcgacgtgtcccccaaacacgtgggctttgccacgatcccacgaaactacaccatgagcttcctgccccgctgagcgagggctgtgctggtgcagggctggtgggcggggccagggaaacggccggggcaggggcggggcttgtgggaggggcggggctaagaatgggggcagtgggggaaggaaggggagaggtggttagagggaacagaagaaacagaaggggctcagttcaccttgatgatgtccttcagagctgtgatgagaggaagggaaaccttacagtatgctacaaagagtagtaataatagcagctcttatttcctgaa

SEQ ID NO: 124369 - DNA, 1764 bp, Homo sapiens
  Payload ID: 4426
  Gene Symbol: CYP2A6
  Gene Name: cytochrome P450, family 2, subfamily A, polypeptide 6
  Uniprot ID: P11509
  ENST ID: ENST00000301141
  CDS Start-End: 22-1506
atctatcatcccactaccaccatgctggcctcagggatgcttctggtggccttgctggtctgcctgactgtaatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaagggcagggccaagaccgggcttgggagaggggcgcagctaagactgggggcaggatggcggaaaggaaggggcgtggtggctagagggaagagaagaaacagaagcggctcagttcaccttgataaggtgcttccgagctgggatgagaggaaggaaacccttacattatgctatgaagagtagtaataatagcagctcttatttcctgagca

SEQ ID NO: 124370 - DNA, 931 bp, Homo sapiens
  Payload ID: 4426
  Gene Symbol: CYP2A6
  Gene Name: cytochrome P450, family 2, subfamily A, polypeptide 6
  ENST ID: ENST00000600495
  CDS Start-End: 22-219
atctatcatcccactaccaccatgctggcctcagggatgcttctggtggccttgctggtctgcctgactgtaatggtcttgatgtctgtttggcagcagaggaagagcaaggggaagctgcctccgggacccaccccattgcccttcattggaaactacctgcagctgaacacagagcagatgtacaactccctcatgaaggtgtcccaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcatt

SEQ ID NO: 124371 - DNA, 1485 bp, Homo sapiens
  Payload ID: 4426
  Gene Symbol: CYP2A6
  Gene Name: cytochrome P450, family 2, subfamily A, polypeptide 6
  ENST ID: ENST00000610301
  CDS Start-End: 1-1485
atgctggcctcagggctgcttctggtggccttgctggcctgcctgactgtgatggtcttgatgtctgtctggcagcagaggaagagcagggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgtaccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctga

SEQ ID NO: 124372 - DNA, 2128 bp, Homo sapiens
  Payload ID: 4427
  Gene Symbol: CYP2A7
  Gene Name: cytochrome P450, family 2, subfamily A, polypeptide 7
  ENST ID: ENST00000291764
  CDS Start-End: 543-1874
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggtgtcccaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 124373 - DNA, 2281 bp, Homo sapiens
  Payload ID: 4427
  Gene Symbol: CYP2A7
  Gene Name: cytochrome P450, family 2, subfamily A, polypeptide 7
  Uniprot ID: P20853
  ENST ID: ENST00000301146
  CDS Start-End: 543-2027
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 124374 - DNA, 572 bp, Homo sapiens
  Payload ID: 4427
  Gene Symbol: CYP2A7
  Gene Name: cytochrome P450, family 2, subfamily A, polypeptide 7
  ENST ID: ENST00000594332
  CDS Start-End: 22-264
atctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggccttt

SEQ ID NO: 124375 - DNA, 3054 bp, Homo sapiens
  Payload ID: 4428
  Gene Symbol: CYP2B6
  Gene Name: cytochrome P450, family 2, subfamily B, polypeptide 6
  Uniprot ID: P20813
  ENST ID: ENST00000324071
  CDS Start-End: 8-1483
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatctcggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagctgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgattttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcatgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtcaa

SEQ ID NO: 124376 - DNA, 1426 bp, Homo sapiens
  Payload ID: 4428
  Gene Symbol: CYP2B6
  Gene Name: cytochrome P450, family 2, subfamily B, polypeptide 6
  ENST ID: ENST00000593831
  CDS Start-End: 113-880
acaaatgaggtgtatgctgactaacagccacccctggtgtggatgtgattggcagttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaaggagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatctcggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctg

SEQ ID NO: 124377 - DNA, 2418 bp, Homo sapiens
  Payload ID: 4429
  Gene Symbol: CYP2C18
  Gene Name: cytochrome P450, family 2, subfamily C, polypeptide 18
  Uniprot ID: P33260
  ENST ID: ENST00000285979
  CDS Start-End: 200-1672
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaa

SEQ ID NO: 124378 - DNA, 1471 bp, Homo sapiens
  Payload ID: 4429
  Gene Symbol: CYP2C18
  Gene Name: cytochrome P450, family 2, subfamily C, polypeptide 18
  Uniprot ID: P33260
  ENST ID: ENST00000339022
  CDS Start-End: 46-1341
tgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccct

SEQ ID NO: 124379 - DNA, 1901 bp, Homo sapiens
  Payload ID: 4430
  Gene Symbol: CYP2C19
  Gene Name: cytochrome P450, family 2, subfamily C, polypeptide 19
  Uniprot ID: P33261
  ENST ID: ENST00000371321
  CDS Start-End: 83-1555
acacacacttaattagcatggagtgttataaaaagcttggagtgcaagctcacggttgtcttaacaagaggagaaggcttcaatggatccttttgtggtccttgtgctctgtctctcatgtttgcttctcctttcaatctggagacagagctctgggagaggaaaactccctcctggccccactcctctcccagtgattggaaatatcctacagatagatattaaggatgtcagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcattggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagagaaagatgatttgtgtattataattcaaaggcatttcttctctgcatgttctaaacaaaaagcattattatttgctga

SEQ ID NO: 124380 - DNA, 1417 bp, Homo sapiens
  Payload ID: 4430
  Gene Symbol: CYP2C19
  Gene Name: cytochrome P450, family 2, subfamily C, polypeptide 19
  ENST ID: ENST00000480405
  CDS Start-End: 26-514
gtcttaacaagaggagaaggcttcaatggatccttttgtggtccttgtgctctgtctctcatgtttgcttctcctttcaatctggagacagagctctgggagaggaaaactccctcctggccccactcctctcccagtgattggaaatatcctacagatagatattaaggatgtcagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaagggtgggtgaacatactctctatcactgacctttctggactgctctcctctctactgacattcttggaaacatttcaggggtggccagatcttttatttggagtcctggttgttagctcatgtgaagcagggtttgaagctgagagccaagggaatttgcacatgtttgtgctgtgtgtgtacaggcatgattgtgcatacagtgtgggtataaaagttcatttaatcctatgttctcctgaactttgcttctttgttttcaaataagaaatgatgaatatagattttgagttcattttttgaaagagttaaagagcagtgtttttcccattatctattccagaacatgtcaccagagaatacttgacaagtggacatggtggaaatggccctatcacacccctagggagcatgaaccaaatggcatgtgcttttatttaattggactatgtttgtatggtcagcctcactgacttgtctagggtttcttttaggcccatgcttgccattctggccagtaatgacattctacagtttttattgcttaggcatatcttagtgtagttctcatcagcttttatttctctgtaaatacagcattatttaaaaaatagtgttaattatttcttgttactctattgattttgagtaaacatatgctatgacataattctgtgaaatacacaaatgtctatttataaaataatttatttaactagattttaattattagtaataactgtaatttttattccttaagtataatttggctctgtttcattttgcttatctctttccaatcatatttatgaaattttggcttagaaatttatggtaattattattttccactgccaactctactcacctatgaagttttacaatgaatcagtttatcagcttggataccaaa

SEQ ID NO: 124381 - DNA, 1923 bp, Homo sapiens
  Payload ID: 4431
  Gene Symbol: CYP2C8
  Gene Name: cytochrome P450, family 2, subfamily C, polypeptide 8
  Uniprot ID: P10632
  ENST ID: ENST00000371270
  CDS Start-End: 96-1568
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttc

SEQ ID NO: 124382 - DNA, 1868 bp, Homo sapiens
  Payload ID: 4431
  Gene Symbol: CYP2C8
  Gene Name: cytochrome P450, family 2, subfamily C, polypeptide 8
  ENST ID: ENST00000527420
  CDS Start-End: 2-1183
aatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttc

SEQ ID NO: 124383 - DNA, 1961 bp, Homo sapiens
  Payload ID: 4431
  Gene Symbol: CYP2C8
  Gene Name: cytochrome P450, family 2, subfamily C, polypeptide 8
  ENST ID: ENST00000490994
  CDS Start-End: 96-347
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttc

SEQ ID NO: 124384 - DNA, 1587 bp, Homo sapiens
  Payload ID: 4431
  Gene Symbol: CYP2C8
  Gene Name: cytochrome P450, family 2, subfamily C, polypeptide 8
  ENST ID: ENST00000525991
  CDS Start-End: 96-395
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaagggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaa

SEQ ID NO: 124385 - DNA, 2024 bp, Homo sapiens
  Payload ID: 4431
  Gene Symbol: CYP2C8
  Gene Name: cytochrome P450, family 2, subfamily C, polypeptide 8
  ENST ID: ENST00000539050
  CDS Start-End: 406-1668
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggtgttttgctatgatttttgactgaaggtgaagggaagtgtgtgtgattagaaatttcatccattctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttca

SEQ ID NO: 124386 - DNA, 1799 bp, Homo sapiens
  Payload ID: 4431
  Gene Symbol: CYP2C8
  Gene Name: cytochrome P450, family 2, subfamily C, polypeptide 8
  Uniprot ID: P10632
  ENST ID: ENST00000535898
  CDS Start-End: 277-1443
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaagggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttca

SEQ ID NO: 124387 - DNA, 1962 bp, Homo sapiens
  Payload ID: 4431
  Gene Symbol: CYP2C8
  Gene Name: cytochrome P450, family 2, subfamily C, polypeptide 8
  ENST ID: ENST00000623108
  CDS Start-End: 344-1606
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttca

SEQ ID NO: 124388 - DNA, 924 bp, Homo sapiens
  Payload ID: 4431
  Gene Symbol: CYP2C8
  Gene Name: cytochrome P450, family 2, subfamily C, polypeptide 8
  ENST ID: ENST00000628935
  CDS Start-End: 1-924
atggctgccaagtgttgcagcactttcttccttggctgtgaattctcccagtttctgcccctttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataa

SEQ ID NO: 124389 - DNA, 1847 bp, Homo sapiens
  Payload ID: 4432
  Gene Symbol: CYP2C9
  Gene Name: cytochrome P450, family 2, subfamily C, polypeptide 9
  Uniprot ID: P11712
  ENST ID: ENST00000260682
  CDS Start-End: 13-1485
gagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctg

SEQ ID NO: 124390 - DNA, 1433 bp, Homo sapiens
  Payload ID: 4433
  Gene Symbol: CYP2D6
  Gene Name: cytochrome P450, family 2, subfamily D, polypeptide 6
  Uniprot ID: P10635
  ENST ID: ENST00000359033
  CDS Start-End: 75-1415
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccc

SEQ ID NO: 124391 - DNA, 1187 bp, Homo sapiens
  Payload ID: 4433
  Gene Symbol: CYP2D6
  Gene Name: cytochrome P450, family 2, subfamily D, polypeptide 6
  ENST ID: ENST00000360124
  CDS Start-End: 1-543
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttccaa

SEQ ID NO: 124392 - DNA, 1684 bp, Homo sapiens
  Payload ID: 4433
  Gene Symbol: CYP2D6
  Gene Name: cytochrome P450, family 2, subfamily D, polypeptide 6
  Uniprot ID: P10635
  ENST ID: ENST00000360608
  CDS Start-End: 116-1609
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttccaa

SEQ ID NO: 124393 - DNA, 1714 bp, Homo sapiens
  Payload ID: 4433
  Gene Symbol: CYP2D6
  Gene Name: cytochrome P450, family 2, subfamily D, polypeptide 6
  ENST ID: ENST00000389970
  CDS Start-End: 157-1641
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcagggaggaagggtacaggcgggggcccatcccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgagcccatccccctatgagctttgtgctgtgccccgctagaatggggtacctagtccccagcctgctccctagccagaggctctaatgtacaataaagcaatgtggtagttcc

SEQ ID NO: 124394 - DNA, 1684 bp, Homo sapiens
  Payload ID: 4433
  Gene Symbol: CYP2D6
  Gene Name: cytochrome P450, family 2, subfamily D, polypeptide 6
  ENST ID: ENST00000607853
  CDS Start-End: 116-1609
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 124395 - DNA, 1684 bp, Homo sapiens
  Payload ID: 4433
  Gene Symbol: CYP2D6
  Gene Name: cytochrome P450, family 2, subfamily D, polypeptide 6
  ENST ID: ENST00000615454
  CDS Start-End: 116-1609
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 124396 - DNA, 1504 bp, Homo sapiens; identical to SEQ ID NO: 103642
  Payload ID: 4433
  Gene Symbol: CYP2D6
  Gene Name: cytochrome P450, family 2, subfamily D, polypeptide 6
  ENST ID: ENST00000619390
  CDS Start-End: 91-1431

SEQ ID NO: 124397 - DNA, 1433 bp, Homo sapiens
  Payload ID: 4433
  Gene Symbol: CYP2D6
  Gene Name: cytochrome P450, family 2, subfamily D, polypeptide 6
  Uniprot ID: P10635
  ENST ID: ENST00000612990
  CDS Start-End: 75-1415
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 124398 - DNA, 1684 bp, Homo sapiens; identical to SEQ ID NO: 124394
  Payload ID: 4433
  Gene Symbol: CYP2D6
  Gene Name: cytochrome P450, family 2, subfamily D, polypeptide 6
  ENST ID: ENST00000630716
  CDS Start-End: 116-1609

SEQ ID NO: 124399 - DNA, 1433 bp, Homo sapiens
  Payload ID: 4433
  Gene Symbol: CYP2D6
  Gene Name: cytochrome P450, family 2, subfamily D, polypeptide 6
  ENST ID: ENST00000629640
  CDS Start-End: 75-1415
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 124400 - DNA, 1187 bp, Homo sapiens
  Payload ID: 4433
  Gene Symbol: CYP2D6
  Gene Name: cytochrome P450, family 2, subfamily D, polypeptide 6
  ENST ID: ENST00000625976
  CDS Start-End: 1-543
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 124401 - DNA, 1187 bp, Homo sapiens
  Payload ID: 4433
  Gene Symbol: CYP2D6
  Gene Name: cytochrome P450, family 2, subfamily D, polypeptide 6
  ENST ID: ENST00000630793
  CDS Start-End: 1-543
ttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 124402 - DNA, 1714 bp, Homo sapiens
  Payload ID: 4433
  Gene Symbol: CYP2D6
  Gene Name: cytochrome P450, family 2, subfamily D, polypeptide 6
  ENST ID: ENST00000625898
  CDS Start-End: 157-1641
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctactcaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggttttgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgcgcatagtggtggctgacctgttctctgccgggatggtgaccacctcgaccacgctggcctggggcctcctgctcatgatcctacatccggatgtgcagcagggaggaagggtacaggcgggggcccatcccattgtggggacgcatgtctgtccaggccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 124403 - DNA, 1187 bp, Homo sapiens; identical to SEQ ID NO: 124401
  Payload ID: 4433
  Gene Symbol: CYP2D6
  Gene Name: cytochrome P450, family 2, subfamily D, polypeptide 6
  ENST ID: ENST00000635505
  CDS Start-End: 1-543

SEQ ID NO: 124404 - DNA, 1433 bp, Homo sapiens; identical to SEQ ID NO: 124399
  Payload ID: 4433
  Gene Symbol: CYP2D6
  Gene Name: cytochrome P450, family 2, subfamily D, polypeptide 6
  ENST ID: ENST00000634653
  CDS Start-End: 75-1415

SEQ ID NO: 124405 - DNA, 1714 bp, Homo sapiens; identical to SEQ ID NO: 124402
  Payload ID: 4433
  Gene Symbol: CYP2D6
  Gene Name: cytochrome P450, family 2, subfamily D, polypeptide 6
  ENST ID: ENST00000635028
  CDS Start-End: 157-1641

SEQ ID NO: 124406 - DNA, 1684 bp, Homo sapiens; identical to SEQ ID NO: 124394
  Payload ID: 4433
  Gene Symbol: CYP2D6
  Gene Name: cytochrome P450, family 2, subfamily D, polypeptide 6
  ENST ID: ENST00000634240
  CDS Start-End: 116-1609

SEQ ID NO: 124407 - DNA, 692 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000435101
  CDS Start-End: 1-138
gacccagcccagccaccccgagacctgactgaggccttcctggcaaagaaggagaaggccaaggggagccctgagagcagcttcaatgatgagaacctgcgcatagtgtccgtgtccaacaggagatcgacgacgtgatagggcaggtgcggcgaccagagatgggtgaccaggctcacatgccctgcaccactgccgtgattcacgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124408 - DNA, 1740 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000433992
  CDS Start-End: 114-1663
aagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgctgacccattgtggggacgcatgtctgtccagtccgtgtccaacaggagatcgacgacgtgatagggcaggtgcggcgaccagagatgggtgaccaggctcacatgccctgcaccactgccgtgattcacgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124409 - DNA, 1655 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000358097
  CDS Start-End: 86-1578
gagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124410 - DNA, 1738 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000575319
  CDS Start-End: 112-1663
gggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgctgacccattgtggggacgcatgtctgtccagtccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124411 - DNA, 1655 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000574062
  CDS Start-End: 86-1580
gagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124412 - DNA, 1504 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000616376
  CDS Start-End: 91-1431
gtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124413 - DNA, 1738 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000620741
  CDS Start-End: 112-1663
gggaagggtcacgcgctcggtgtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagcgacgaaggagagtgtcccctgggtgctgacccattgtggggacgcatgtctgtccagtccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124414 - DNA, 1734 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000619036
  CDS Start-End: 114-1661
aagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgccccattgtggggacgcatgtctgtccagtccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124415 - DNA, 1504 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000614621
  CDS Start-End: 91-1431
gtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124416 - DNA, 1504 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000614967
  CDS Start-End: 91-1431
gtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124417 - DNA, 1734 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000617651
  CDS Start-End: 114-1661
aagggaagggtcacgcgctcggtgtgctgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagcgacgaaggagagtgtcccctgggtgccccattgtggggacgcatgtctgtccagtccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124418 - DNA, 1657 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000612408
  CDS Start-End: 91-1584
gtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctgcaccactgccgtgattcacgaggtgcagcgctttggggacatcatccccctgagtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124419 - DNA, 1734 bp, Homo sapiens
  Payload ID: 4434
  Gene Symbol: CYP2D7
  Gene Name: cytochrome P450, family 2, subfamily D, polypeptide 7 (gene/pseudogene)
  Uniprot ID: A0A087X1C5
  ENST ID: ENST00000612115
  CDS Start-End: 114-1661
aagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgccccattgtggggacgcatgtctgtccagtccgtgtccaacaggagatcgacgacgtgatagggcaggtgcggcgaccagagatgggtgaccaggctcacatgccctgcaccactgccgtgattcacgaggtgcagcactttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124420 - DNA, 692 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000618719
  CDS Start-End: 1-138
gacccagcccagccaccccgagacctgactgaggccttcctggcaaagaaggagaaggccaaggggagccctgagagcagcttcaatgatgagaacctgcgcatagtgtccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124421 - DNA, 1576 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000629682
  CDS Start-End: 7-1501
gcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgttcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcctgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccaccttgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcacgaggtgcagcgctttggggacatcatccccctgagtgtgacccatatgacatcccatgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124422 - DNA, 1655 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000634785
  CDS Start-End: 86-1578
gagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124423 - DNA, 1504 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000635668
  CDS Start-End: 91-1431
gtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagctccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124424 - DNA, 1740 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000635170
  CDS Start-End: 114-1663
aagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaaccttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgctgacccattgtggggacgcatgtctgtccagtccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124425 - DNA, 692 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000634782
  CDS Start-End: 1-138
gacccagcccagccaccccgagacctgactgaggccttcctggcaaagaaggagaaggccaaggggagccctgagagcagcttcaatgatgagaacctgcgcatagtgtccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttccaa

SEQ ID NO: 124426 - DNA, 1734 bp, Homo sapiens
  Payload ID: 4434
  Gene Symbol: CYP2D7
  Gene Name: cytochrome P450, family 2, subfamily D, polypeptide 7 (gene/pseudogene)
  ENST ID: ENST00000635135
  CDS Start-End: 114-1661
aagggaagggtcacgcgctcggtgtgccgagagtgtcctgcctggtcctctgtgcctggtggggtgggggtgccaggtgtgtccagaggagcccagttggtagtgaggcagccatggggctagaagcactggtgcccctggccatgatagtggccatcttcctgctcctggtggacctgatgcaccggcaccaacgctgggctgcacgctacccgccaggtcccctgccactgcccgggctgggcaacttgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgatggtgacccgcggcgaggacacggccgaccgcccgcctgcgcccatctaccaggtcctgggcttcgggccgcgttcccaaggggtgatcctgtcgcgctatgggcccgcgtggcgcgagcagaggcgcttctccgtgtccaccttgcgcaacttgggcctgggcaagaagtcgctggagcagtgggtgaccgaggaggccgcctgcctttgtgccgccttcgccgaccaagccggacgcccctttcgccccaacggcctcttggacaaagccgtgagcaacgtgatcgcctccctcacctgcgggcgccgcttcgagtacgacgaccctcgcttcctcaggctgctggacctagctcaggagggactgaaggaggagtcgggcttcctgcgcgaggtgctgaatgctgtccccgtcctcccgcacatcccagcgctggctggcaaggtcctacgcttccaaaaggctttcctgacccagctggatgagctgctaactgagcacaggatgacctgggacccagcccagccaccccgagacctgactgaggccttcctggcaaagaaggagaaggccaaggggagccctgagagcagcttcaatgatgagaacctgcgcatagtggtgggtaacctgttccttgccgggatggtgaccacctcgaccacgctggcctggggcctcctgctcatgatcctacacctggatgtgcagcgaggaaggagagtgtcccctgggtgccccattgtggggacgcatgtctgtccagtccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctggaagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctccgtggccgccggacagccccggcccagccactctcgtgtcgtcagctttctggtgaccccatccccctacgagctttgtgctgtgccccgctagaatggggtacctagtccccagcctgctccctagccagaggctctaatgtacaataaagcaatgtggtagttcc

SEQ ID NO: 124427 - DNA, 1667 bp, Homo sapiens
  Payload ID: 4435
  Gene Symbol: CYP2E1
  Gene Name: cytochrome P450, family 2, subfamily E, polypeptide 1
  Uniprot ID: P05181
  ENST ID: ENST00000252945
  CDS Start-End: 34-1515
ctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattatttt

SEQ ID NO: 124428 - DNA, 918 bp, Homo sapiens
  Payload ID: 4435
  Gene Symbol: CYP2E1
  Gene Name: cytochrome P450, family 2, subfamily E, polypeptide 1
  ENST ID: ENST00000418356
  CDS Start-End: 1-918
aggccctttcccgcttcccatcatcgggaacctcttccagttggaattgaagaatattcccaagtccttcacccgggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggct

SEQ ID NO: 124429 - DNA, 1068 bp, Homo sapiens
  Payload ID: 4435
  Gene Symbol: CYP2E1
  Gene Name: cytochrome P450, family 2, subfamily E, polypeptide 1
  ENST ID: ENST00000421586
  CDS Start-End: 1-1068
aggccctttcccgcttcccatcatcgggaacctcttccagttggaattgaagaatattcccaagtccttcacccgggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggct

SEQ ID NO: 124430 - DNA, 475 bp, Homo sapiens
  Payload ID: 4435
  Gene Symbol: CYP2E1
  Gene Name: cytochrome P450, family 2, subfamily E, polypeptide 1
  ENST ID: ENST00000541261
  CDS Start-End: 216-475
aacagtattatggccagaggactcagaccacagctgcatccctgtgaggcacagactctccagggcacgcgggtcccgcctgggatgtgcacactcagttaacttgagaaagtggaatcgaattccgatgttgaattttccttctggccccattcatgtggcaggtggtgattcaggattgtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaa

SEQ ID NO: 124431 - DNA, 1912 bp, Homo sapiens
  Payload ID: 4435
  Gene Symbol: CYP2E1
  Gene Name: cytochrome P450, family 2, subfamily E, polypeptide 1
  Uniprot ID: P05181
  ENST ID: ENST00000463117
  CDS Start-End: 273-1754
acttccgggttgtttgctcccggagccataaccgcagctcagcgtgcgggcagagccggctgacaggagacaggacacagcacagagccccgcgccctctgaggcgggaggcttcgttcctgcaccagcgtggcttgccctttggacgcggcgagttaacttgagaaagtggaatcgaattccgatgttgaattttccttctggccccattcatgtggcaggtggtgattcaggattgtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagatcgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattattttaactat

SEQ ID NO: 124432 - DNA, 745 bp, Homo sapiens
  Payload ID: 4435
  Gene Symbol: CYP2E1
  Gene Name: cytochrome P450, family 2, subfamily E, polypeptide 1
  ENST ID: ENST00000541080
  CDS Start-End: 1-130
aggccctttcccgcttcccatcatcgggaacctcttccagttggaattgaagaatattcccaagtccttcacccgggaatcatttttaataatggacctacctggaaggacatccggcggttttccctgaccaccctccggaactatgggatggggaaacagggcaatgagagccggatccagagggaggcccacttcctgctggaagcactcaggaagacccaagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagttcaagtacagtgactatttcaagccattttccacaggaaaacgagtgtgtgctggagaaggcctggct

SEQ ID NO: 124433 - DNA, 1720 bp, Homo sapiens
  Payload ID: 4436
  Gene Symbol: CYP2F1
  Gene Name: cytochrome P450, family 2, subfamily F, polypeptide 1
  Uniprot ID: P24903
  ENST ID: ENST00000331105
  CDS Start-End: 73-1548
aagcacacccagagctgcaggctctagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggagctgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcttcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagtcgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccgcccatgcgggttgctacgtccccttcttggtccacagtctgccctcatccctctggcagtcacgctgtcttccctgcatgctgtgcctgccgcgtgcccttcccccatccctccaatctgtgccccgtct

SEQ ID NO: 124434 - DNA, 710 bp, Homo sapiens
  Payload ID: 4436
  Gene Symbol: CYP2F1
  Gene Name: cytochrome P450, family 2, subfamily F, polypeptide 1
  ENST ID: ENST00000439903
  CDS Start-End: 1-244
gccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgctttggatgcacagagacattcattcctcctctcaactctgctcctatagggcgccgtctgtgcctgggagagtcgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccgcccatgcgggttgctacgtccccttcttggtccacagtctgccctcatccctctggcagtcacgctgtcttccctgcatgctgtgcctgccgcgtgcccttcccccatccctccaatctgtgccccgtctgcagggcagaggcagatgtggcatgtctttttgtacccacagagcttgttctatggcacgcccttttctaggctttttgtatcatttcttagtacattgtaatagattcaaa

SEQ ID NO: 124435 - DNA, 516 bp, Homo sapiens
  Payload ID: 4436
  Gene Symbol: CYP2F1
  Gene Name: cytochrome P450, family 2, subfamily F, polypeptide 1
  ENST ID: ENST00000534009
  CDS Start-End: 1-516
gcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctggtgagggcaggaatcagagtctttctggcccaatttctacctacattcctcaccctaattccacttgccaaatcctctcactccttccttccacccattctcagctttggatgcacagagacattcattcctcctctcaactctgctcctataggcaagtagtgactaaaatcctcgtgaagcaa

SEQ ID NO: 124436 - DNA, 1662 bp, Homo sapiens
  Payload ID: 4436
  Gene Symbol: CYP2F1
  Gene Name: cytochrome P450, family 2, subfamily F, polypeptide 1
  Uniprot ID: P24903
  ENST ID: ENST00000532164
  CDS Start-End: 73-1035
aagcacacccagagctgcaggctctagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggagctgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcttcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacgcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagtcgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccgcccatgcgggttgctacgtccccttcttggtccacagtctgccctcatccctctggcagtcacgctgtcttccctgcatgctgtgcctgccgcgtgcccttcccccatccctccaatctgtgccccgtct

SEQ ID NO: 124437 - DNA, 1896 bp, Homo sapiens
  Payload ID: 4437
  Gene Symbol: CYP2J2
  Gene Name: cytochrome P450, family 2, subfamily J, polypeptide 2
  Uniprot ID: P51589
  ENST ID: ENST00000371204
  CDS Start-End: 45-1553
cgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 124438 - DNA, 2235 bp, Homo sapiens
  Payload ID: 4438
  Gene Symbol: CYP2R1
  Gene Name: cytochrome P450, family 2, subfamily R, polypeptide 1
  Uniprot ID: Q6VVX0
  ENST ID: ENST00000334636
  CDS Start-End: 48-1553
cctgggtctcagggctgctgtggagttcgcacctccagctcgggccgatgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatgaacacagatgtgtcttaaaatagtactagagcagaaacaagcactagtcgtgattgtttttcaagattttatgacttctggggtaaaattctctgttgagagacacaaaggtgcaaatgatgggtgttgcttaaaatgctaagaagggtcatggacgccctaagctgagcatcttgtttagtaccaggtactttcatcccttcttgactccatctgccttctgtcctggggggccttggttccagaaaccagctcccttctgatcaggtattgtcattaataaactgtgtggtaccagtccagtttaatagaggactacagaagaaattaaaacacaaataaatgagttaggactatagaggtattttagatatggtgggagatggtagaagaaatatgtatttaatgtagagcctgccagtgctttcatatcttgcttcctgctctgtcttcataagaactgtgtcattcttcttataaatgagggtctgtgtgaccctgagtgtccatcttcatagcagttaagtagataggacattacaataatatatttaaaatttaaaatga

SEQ ID NO: 124439 - DNA, 1668 bp, Homo sapiens
  Payload ID: 4438
  Gene Symbol: CYP2R1
  Gene Name: cytochrome P450, family 2, subfamily R, polypeptide 1
  ENST ID: ENST00000534686
  CDS Start-End: 576-689
gccacttcaggtccagggtggacgcatgccctcaggtgcgggcgtcttgcgagtcggcctcgcagctctgtggaagctgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaa

SEQ ID NO: 124440 - DNA, 1746 bp, Homo sapiens
  Payload ID: 4438
  Gene Symbol: CYP2R1
  Gene Name: cytochrome P450, family 2, subfamily R, polypeptide 1
  ENST ID: ENST00000532378
  CDS Start-End: 856-1662
tccagggtggacgcatgccctcaggtgcgggcgtcttgcgagtcggcctcgcagctctgtggaagctgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtgtgggtgtcccgacgtccggagggggcaggagtttccacgggtcctgggacagagctcacctgttttgttttgaattacacttatttatatgcaactacaggcctgacgctagcggtgaagaaggcagatacagccttttaaggagttggcagatgagtgggagagagaaaactaatctcattatcggccacaggctgtggtcagtgttttgaaggaaaagtacagggatgtttggcaactgtggtatttcagtttacgttgttaaagggaagctggacgagataataaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattag

SEQ ID NO: 124441 - DNA, 2325 bp, Homo sapiens
  Payload ID: 4438
  Gene Symbol: CYP2R1
  Gene Name: cytochrome P450, family 2, subfamily R, polypeptide 1
  ENST ID: ENST00000532805
  CDS Start-End: 1483-1596
tttctcaagccatggctcctccttgctttttatgatccctggtgtccacaatttgaagctctaccctgaagctctatcctgaaatacatttgccctctgttctgccttcatagtgacacaactttaagttcatggctcttttactatccttgtggaatggcatctttttattgtctctgctaaagttcccttctgcgaagagactttcctttaataggactacattactgcattgtccccactttgctcggctggtagccattcccttttacttagaactcttctactgtcacttttgactaataccactgcttatggcaggcagtccatgttcttttcccaaggttctggatatacctagtgctcacttggcagagcccacccgtgtgccaaagactctggtggccccattactcagctggttagttgttaccacttggcagtcctcatgacctttgctgatataactttctgctgaacttttgttctctgctaagcctcctgttttcttctgaagtagtgtgtaccatggctaaatctccttgacttgtttgcacagggataaggcttgtctcagtattttggctgtaaaatgctatcctgaaaggatggcaataagcaatctttacattccactgataagggaatatcgttctctcactgactggcctcttatattgggttaactagaatagactacaggaggtgtgacattgtaagtgaacctggggtgaggcacagggcagacaactccagcaaggcatggaatggatcctgttttgccttccccttaactgagaggcagccacctaacctatgtggtaaatgcctttcctccaaggttaggttcccttagagccctcttcattcactttgtggaatacagagagccaaatacaaatgggcttagttacaatatgtttatacttcaaagttgtctctcaggtatttgacaatcctctccctcactagcctcattcatcttggaaatagaaggagattcctagatatcattgaacattttgaggtaaaatgaatcataaaagagcatatatatcaaatatattttctatggcaatactgaagcccagataggttaagtgttctgctcagagtcttttatctgtttaatggcaaaccttaaactagacccaggcctcccgagtccagtacccttttcattatactgttggtaagactgtgactttaggcactgaatggcataatgaaatcacacagttttgcatgccttatagaaggagggcactctgaacattgtcagttgagtaataactgcctatattttcagggacgtaacaaatcctggaagagccgcacttaccacttgtagatttccatggttatatttctccatacatgctgtcatttaaatgttgtttttcttctcttctcaaagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtaagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaatg

SEQ ID NO: 124442 - DNA, 1882 bp, Homo sapiens
  Payload ID: 4438
  Gene Symbol: CYP2R1
  Gene Name: cytochrome P450, family 2, subfamily R, polypeptide 1
  ENST ID: ENST00000530609
  CDS Start-End: 554-667
cgcatgccctcaggtgcgggcgtcttgcgagtcggcctcgcagctctgtggaagctgcacgcggcttgtcggaaaatcaaggcgttctgagttctagatggttaatagcaggttcttcggtgtctgcagtcgacgaacgactggtgtaggcgtttgctgtgagaatggagaatgcaggggaacgcccctgactgagaagcgggccctgggaaacgattgtgaacgcgtgaatgaattgatgactaaaatccgctgcgggggtcctacagcgcagatggtaatgccgttctgactggctgggaacggcaccttagcagatacttaaaaggcgccttctgtgtgccactgtcactgccaacttggtgactcatttaaaactcataaccagccggtgaggtcggtacttcgctcctcctcattctgcggaggggaaagcagcacggaaatgccctgtgactggcagcggaaaaggcgaccaccgcttgtgtatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagccaaa

SEQ ID NO: 124443 - DNA, 446 bp, Homo sapiens
  Payload ID: 4438
  Gene Symbol: CYP2R1
  Gene Name: cytochrome P450, family 2, subfamily R, polypeptide 1
  ENST ID: ENST00000525015
  CDS Start-End: 1-98
atcaaagcgaaatttttgcagacagaccatgccttcctttattcatgaagatgacaaaaatgggagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtttaatcaaatcaatgtgtgtattagaataaaagtcacagcatcaaaaagcc

SEQ ID NO: 124444 - DNA, 2782 bp, Homo sapiens
  Payload ID: 4439
  Gene Symbol: CYP2S1
  Gene Name: cytochrome P450, family 2, subfamily S, polypeptide 1
  Uniprot ID: Q96SQ9
  ENST ID: ENST00000310054
  CDS Start-End: 217-1731
acatccgttggagcatgagttcccgacatcaggcggcggcggtggtccgggagaaacccggcggcggggagataagcctgcccaggaggcagggggctgggctagctgccccgccccgcgcctgacttcgttggggagggagacgcccggctcccgcccctaactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagccta

SEQ ID NO: 124445 - DNA, 759 bp, Homo sapiens
  Payload ID: 4439
  Gene Symbol: CYP2S1
  Gene Name: cytochrome P450, family 2, subfamily S, polypeptide 1
  ENST ID: ENST00000595590
  CDS Start-End: 231-413
accgaggctgaaagagacaggagtcctccagccgaggagaagctgatgcagctgggcttgtcccagagggagaggtagctggagccatacagctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctg

SEQ ID NO: 124446 - DNA, 510 bp, Homo sapiens
  Payload ID: 4439
  Gene Symbol: CYP2S1
  Gene Name: cytochrome P450, family 2, subfamily S, polypeptide 1
  ENST ID: ENST00000593890
  CDS Start-End: 1-222
gctgtttgctgggacgatgacggtcagcaccacggtcggctataccctcctgctcctgatgaaataccctcatgtccaaaggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtct

SEQ ID NO: 124447 - DNA, 580 bp, Homo sapiens
  Payload ID: 4439
  Gene Symbol: CYP2S1
  Gene Name: cytochrome P450, family 2, subfamily S, polypeptide 1
  ENST ID: ENST00000600561
  CDS Start-End: 19-580
aggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggaggaacaaaacccaggcacagaattcaccaacaagaacatgctgatgacagtcatttatttgctgttt

SEQ ID NO: 124448 - DNA, 580 bp, Homo sapiens
  Payload ID: 4439
  Gene Symbol: CYP2S1
  Gene Name: cytochrome P450, family 2, subfamily S, polypeptide 1
  ENST ID: ENST00000597754
  CDS Start-End: 56-580
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcgggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttcccc

SEQ ID NO: 124449 - DNA, 1479 bp, Homo sapiens
  Payload ID: 4439
  Gene Symbol: CYP2S1
  Gene Name: cytochrome P450, family 2, subfamily S, polypeptide 1
  ENST ID: ENST00000593545
  CDS Start-End: 27-524
agaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccctggcggcctgtggtggtcctggttgggcaggaggctgtgcgggaggccctgggaggtcaggctgaggagttcagcggccggggaaccgtagcgatgctggaagggacttttgatggccatggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtg

SEQ ID NO: 124450 - DNA, 4944 bp, Homo sapiens
  Payload ID: 4440
  Gene Symbol: CYP2U1
  Gene Name: cytochrome P450, family 2, subfamily U, polypeptide 1
  Uniprot ID: Q7Z449
  ENST ID: ENST00000332884
  CDS Start-End: 276-1910
accggacttcggggcaaacttcaggtcccccgcctgctagcccgccaaccccctccgccaggcagccggcgcgcctccaggttccgcccaggcgtcgctgagtggcggcggcggggagaatgcgcgcggcgcagccaatccgggggcgttcctacaccccctgcccgcccccgaccttccagagcagagcaggacactggcgccgcgggtcaggcagctgcgtgcgcgtctcctccaggcagcaaggggaacccgaggccgccggcgcccggaccatgtcgtctccggggccgtcgcagccgccggccgaggacccgccctggcccgcgcgcctcctgcgtgcgcctctggggctgctgcggctggaccccagcgggggcgcgctgctgctatgcggcctcgtagcgctgctgggctggagctggctgcggaggcgccgggcgcggggcatcccgcccgggcccacgccctggcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaagggggttgtgtttgcacattatggtcccgtctggagacaacaaaggaagttctctcattcaactcttcgtcattttgggttgggaaaacttagcttggagcccaagattattgaggagttcaaatatgtgaaagcagaaatgcaaaagcacggagaagaccccttctgccctttctccatcatcagcaatgccgtctctaacatcatttgctccttgtgctttggccagcgctttgattacactaatagtgagttcaagaaaatgcttggttttatgtcacgaggcctagaaatctgtctgaacagtcaagtcctcctggtcaacatatgcccttggctttattaccttccctttggaccatttaaggaattaagacaaattgaaaaggatataaccagtttccttaaaaaaatcatcaaagaccatcaagagtctctggatagagagaaccctcaggacttcatagacatgtaccttctccacatggaagaggagaggaaaaataatagtaacagcagttttgatgaagagtacttattttatatcattggggatctctttattgctgggactgataccacaactaactctttgctctggtgcctgctgtatatgtcgctgaaccccgatgtacaagaaaaggttcatgaagaaattgaaagagtcattggcgccaaccgagctccttccctcacagacaaggcccagatgccctacacagaagccaccatcatggaagtgcagaggctaactgtggtggtgccgcttgccattcctcatatgacctcagagaacacagtgctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatgggccaatcttctcatttcttagtgcctcagacatcccatatgtaaaatgagagtaataaaacttggcttctctctacctctcagcactaatgatggtcaaatgccttacatcttttctgatatctctaaaatgctgttaagttctggagaagaacttcaggagaagaagatctatcagctggcttttaaagacctatgacaacatgaaagtggtgttcagcctggaatgctttgtcagagatgggtgtggatttaggttatactgggggagaacttttctcagcacagattctatgccagcttctttgggcttgttctgtcactatctttttgtttatgattttagtttttactttttgtagatgtgggatgaagtggactctgtcgtgtatattgaggaaaaaagaaattataattttaaaaaatcccttgtaggattattatctaaatttatatgtctaacttctactacaactacaggaacagtgagccttgctacttctttagtagcttcttggcagaattcctttctactgagttatttgcaaagatgcagctctacctttttacttaaggcctgaatggtgagcatggggattttgatactgggactcatcaggaaaggattctgctttcaaactatactgaacattcctgtcctagcgtccctgccaccaggcccaatgcatctgatccttgaatatactctcaaagaattcactctctttttattaagagaactaaattgtttctaaatgtagatggtccctctggaaaagcagttttcagcaggggtggtaaccccttcagagggagtttggaaatgtgtgggtatgattcttggttatcataatgatgggggtgctactggccttctgctgccatgggaccaggatgctaaatgtcaaggtagtcctatacagtgaagaattgtcctgctcaagatgccaggatttcccccagtgagaacatgctctaaggaatgaccacccctttcttttattctcccacagtgctccatgtacagaagtaagcatagcagtcatatgagcaaccacattcctgaacctttcctcatgctggctctacacttaatcctttacttgtatgtttctgtaattcttacataaattctattaagagggtggcatactgtagtggatgaagctgaggcttatagtaggtaaggcacaaagttaaaaagtaacatcactgggtttcaaacctactggtctctgtgactaaagaacactttcagaaccacttcttgattctgccaccacttgatcccataacaggctaccccttggcctcatgctggagttgtgtgtgtctgtcttcatcccaggctgagctccttgaggtgaggatgttgtgctgtttgcctccctcacagtgccttggtcttagtggatgcccagttgtcttgtgaatgacttttaagaagtgtacttaagagaaaaatcctaccttatttgaataattacaagtcatgtttttgttgcttaaaggtgataaatcagtgtatattatttgttaatgtccattaaagccagtttttaaaaaaatcactggacttttgtgtttaccatttaaaacaaccattttaaacaaacttagaacgatgccttagctgtttataggtaacagaatgtaaactcccaccacctggagactaggccatatccagggacctcacactgactttcctaaaggagagaagcagctacgctgttcatactgatagagaagagggcaagaaaagatccagagtggctgttactttgaaaattaaacgaaagatgaaattctgaacttaaaacacttctgtttggccttctataactgatcacccttctttgctctgttttccagataaatggagacaccagatctccctaacctctgacttctgccgttagccatactctgtgtagttagatctcagtctgggaatggcattccagggcaattgtgaacatgaggctagatttttcctttgatttagcacattcctaggcagacttttgcaagctcaaaaaatgaaaataatatctgcttaaccaaaacataatcataggaagaagaaaaattttaaaatgattgatttttgactctacattctttatctaccatactgctcttttcctttttagaaatattactaagcactttccgtatagataaatgaaatacaggctaatctttaggtgtcttaggaatttttgctttttgaaaaagaaaagctaatagcctaactgcagaggaactgagtggatggggtagctgctgtatagatttttagatgagatgatacagtgtggattacactgtaccttgggcgggagagtttgttcttgatatggaattcatatgcttttgaattgcactaataactcagcattaacaagtatattactccttaaattatacatgcattttcaatattcctaaccaaatagtttatagcttattgagaagaagtctgttcttggagagatgttgaaattagatgtttattaaactttaaaatataatgccttaagctgtggcactttaaaaacatctttatatataaattgctaaaaggactgttaatgcttttctcagacacattggcattttacaattttgcacatggtttatttgaaatcaaaaaataactatactttgttttataagtctacctaatatctcatttttgattctcatcgttagcacagttttgttgcttttattaaactattttaa

SEQ ID NO: 124451 - DNA, 3125 bp, Homo sapiens
  Payload ID: 4440
  Gene Symbol: CYP2U1
  Gene Name: cytochrome P450, family 2, subfamily U, polypeptide 1
  ENST ID: ENST00000508453
  CDS Start-End: 874-1881
gtctcctccaggcagcaaggggaacccgaggccgccggcgcccggaccatgtcgtctccggggccgtcgcagccgccggccgaggacccgccctggcccgcgcgcctcctgcgtgcgcctctggggctgctgcggctggaccccagcgggggcgcgctgctgctatgcggcctcgtagcgctgctgggctggagctggctgcggaggcgccgggcgcggggcatcccgcccgggcccacgccctggcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaaggcatgaaggcccttgccagatgccagtgctatcctcttggacttcccagccttcagaactcacctgttccttggacaagaatacctgcttcttctgaggaattccttttttctgacctcagtcccttttacccttaactgtggttgaacggcagatgccatatctttacataaactcaccttcttggccacagtgataagggttgtgtttgcacattatggtcccgtctggagacaacaaaggaagttctctcattcaactcttcgtcattttgggttgggaaaacttagcttggagcccaagattattgaggagttcaaatatgtgaaagcagaaatgcaaaagcacggagaagaccccttctgccctttctccatcatcagcaatgccgtctctaacatcatttgctccttgtgctttggccagcgctttgattacactaatagtgagttcaagaaaatgcttggttttatgtcacgaggcctagaaatctgtctgaacagtcaagtcctcctggtcaacatatgcccttggctttattaccttccctttggaccatttaaggaattaagacaaattgaaaaggatataaccagtttccttaaaaaaatcatcaaagaccatcaagagtctctggatagagagaaccctcaggacttcatagacatgtaccttctccacatggaagaggagaggaaaaataatagtaacagcagttttgatgaagagtacttattttatatcattggggatctctttattgctgggactgataccacaactaactctttgctctggtgcctgctgtatatgtcgctgaaccccgatgtacaagaaaaggttcatgaagaaattgaaagagtcattggcgccaaccgagctccttccctcacagacaaggcccagatgccctacacagaagccaccatcatggaagtgcagaggctaactgtggtggtgccgcttgccattcctcatatgacctcagagaacacagtgctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatgggccaatcttctcatttcttagtgcctcagacatcccatatgtaaaatgagagtaataaaacttggcttctctctacctctcagcactaatgatggtcaaatgccttacatcttttctgatatctctaaaatgctgttaagttctggagaagaacttcaggagaagaagatctatcagctggcttttaaagacctatgacaacatgaaagtggtgttcagcctggaatgctttgtcagagatgggtgtggatttaggttatactgggggagaacttttctcagcacagattctatgccagcttctttgggcttgttctgtcactatctttttgtttatgattttagtttttactttttgtagatgtgggatgaagtggactctgtcgtgtatattgaggaaaaaagaaattataattttaaaaaatcccttgtaggattattatctaaatttatatgtctaacttctactacaactacaggaacagtgagccttgctacttctttagtagcttcttggcagaattcctttctactgagttatttgcaaagatgcagctctacctttttacttaaggcctgaatggtgagcatggggattttgatactgggactcatcaggaaaggattctgctttcaaactatactgaacattcctgtcctagcgtccctgccaccaggcccaatgcatctgatccttgaatatactctcaaagaattcactctctttttattaagagaactaaattgtttctaaatgtagatggtccctctggaaaagcagttttcagcaggggtggtaaccccttcagagggagtttggaaatgtgtgggtatgattcttggttatcataatgatgggggtgctactggccttctgctgccatgggaccaggatgctaaatgtcaaggtagtcctatacagtgaagaattgtcctgctcaagatgccaggatttccccc

SEQ ID NO: 124452 - DNA, 2304 bp, Homo sapiens
  Payload ID: 4441
  Gene Symbol: CYP2W1
  Gene Name: cytochrome P450, family 2, subfamily W, polypeptide 1
  Uniprot ID: Q8TAV3
  ENST ID: ENST00000308919
  CDS Start-End: 14-1486
cagccacgtcctcatggccctgctgctcttgctgttcctgggcctcctggggctctgggggctgctctgcgcctgcgcccaagacccctccccagctgcccggtggcccccggggcctcgcccgctgccgctcgtcgggaacctgcacttgctgcgtctgtcgcaacaggaccggtccctgatggagctctcagaacgctacgggccggtgttcaccgtgcacctggggcgccagaagacggtggtgctgacggggttcgaggcggtcaaagaggcgctggcgggccccgggcaggagctggccgaccggcctcccatcgccatcttccagctcatccagcgaggtggaggcatcttcttctcatctggggcgcgctggagggctgcccgccagttcacggtgcgtgccctgcacagcctgggcgtgggccgggagccggtggctgacaagattctgcaggagctgaaatgcctctctgggcagctggatggctacagaggccggcccttcccgctggccctactgggctgggctccctccaatatcaccttcgcgctcctcttcggccgccgatttgactaccgggaccccgtgtttgtgtccctgctgggtctcatcgatgaggtcatggtcctcttggggtcccctggcctgcagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgtgcggtgcccaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggctcatgcctgtaatcccagcactttgggaggccgaggcaggcgaatcacgaggtcaggagttcgagaccagcctgcccaacatggtgaaaccctgtctctactaaaaatacaaaaaaattaaccgag

SEQ ID NO: 124453 - DNA, 2361 bp, Homo sapiens
  Payload ID: 4441
  Gene Symbol: CYP2W1
  Gene Name: cytochrome P450, family 2, subfamily W, polypeptide 1
  ENST ID: ENST00000340150
  CDS Start-End: 23-1249
gtcgcaacaggaccggtccctgatggagctctcagaacgctacgggccggtgttcaccgtgcacctggggcgccagaagacggtggtgctgacggggttcgaggcggtcaaagaggcgctggcgggccccgggcaggagctggccgaccggcctcccatcgccatcttccagctcatccagcgaggtggaggcatcttcttctcatctggggcgcgctggagggctgcccgccagttcacggtgcgtgccctgcacagcctgggcgtgggccgggagccggtggctgacaagattctgcaggagctgaaatgcctctctgggcagctggatggctacagaggccggcccttcccgctggccctactgggctgggctccctccaatatcaccttcgcgctcctcttcggccgccgatttgactaccgggaccccgtgtttgtgtccctgctgggtctcatcgatgaggtcatggtcctcttggggtcccctggcctgcagctgttcaacgtctacccatggctcggggccctgctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggtcagcagccctcggggccggggtggggcggcacctccagggctccaggggtgggacggccccagctccgcctgccgcctctgcacccacctcctgatctcaggttctgaaggcggctgtggtggctgctcctgtgctcccctggggaggtccccacccctcccctccaggagcaggcctggtgcagcccactctgtgcctggacatcccccgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgtgcggtgcccaggccctaggagctcccccagcccccaggtcctcctgaccactcccctcccagccctgggtcctcccaccctctctcctcccaccccacagctcggactgctctgggagggccctgaggactcccaccctcacccccacccccacagggtcagcaactgcttccggttacacccaggactacccctgcccgaccctgtgggacccccacccctctgatgctgtctgcagctcagtccctgccagcccccaggagcgcctccagggccccgcccactctcccacccctgaagctgcactcccacccacctagctccccccagggccccccagcacctacagctggggctgcagggagacaacgggtggctgcatccagccagagacaggcgcaggtgggtgtcctcagcgtgcgagccctgcaccccccaggtcctgggactcctgcagaccccactccattcccgctcctggaacacttcctgcagctgtgcctggaggcagtcggcctgcagtgccagactctgagccaagccactggggccatgcgtatgactggtgcagggaggcaaggcccacattctccttcagagacaggcactggcgccagaggcttccttggggcggggggagggcacctcagcccctgaagacaagcagcactgcagtggcaaaaatggaaacactgacccggtgcggtggctcatgcctgtaatcccagcactttgggaggccgaggcaggcgaatcacgaggtcaggagttcgagaccagcctgcccaacatggtgaaaccctgtctctactaaaaatacaaaaaaattaaccgag

SEQ ID NO: 124454 - DNA, 890 bp, Homo sapiens
  Payload ID: 4441
  Gene Symbol: CYP2W1
  Gene Name: cytochrome P450, family 2, subfamily W, polypeptide 1
  ENST ID: ENST00000415893
  CDS Start-End: 1-867
ctccagctgcaccggcccgtcctgcgcaagatcgaggaggtccgtgccattctgaggaccctcctggaggcgcggaggccccacgtgtgcccgggggaccccgtgtgcagctatgtggacgccctgatccagcagggacagggggatgaccccgagggcctgtttgctgaggccaacgcggtggcctgcaccctggacatggtcatggccgggacggagacgacctcggccacgctgcagtgggccgcacttctgatgggccggcacccggacgtgcagggccgggtgcaggaggagctagaccgcgtgctgggccctgggcggactccccggctggaggaccagcaggctctgccctacacaagcgccgtgctccacgaggtgcagcggttcatcacgctcctgccgcacgtgccccgctgcaccgcggccgacacacagctgggcggcttcctgctccccaagggcacgcccgtgattcccctgctgacctcggtgctcctggatgagacacagtggcagaccccaggccagttcaaccccggccatttcctggacgcgaatgggcactttgtgaagcgggaggccttcctgcctttctctgcaggttctgaaggcggctgtggtggctgctcctgtgctcccctggggaggtccccacccctcccctccaggagcaggcctggtgcagcccactctgtgcctggacatcccccgcaggccgccgcgtctgtgttggggagcgcctggccaggaccgagctcttcctgctgtttgccggcctcctgcagaggtaccgcctgctgcccccgcctggcgtcagtccggcctccctggacaccacgcccgcccgggcttttaccatgaggccgagggcccaggccctgtgt

SEQ ID NO: 124455 - DNA, 1949 bp, Homo sapiens
  Payload ID: 4442
  Gene Symbol: CYP20A1
  Gene Name: cytochrome P450, family 20, subfamily A, polypeptide 1
  Uniprot ID: Q6UW02
  ENST ID: ENST00000356079
  CDS Start-End: 124-1512
gcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtgg

SEQ ID NO: 124456 - DNA, 2636 bp, Homo sapiens
  Payload ID: 4442
  Gene Symbol: CYP20A1
  Gene Name: cytochrome P450, family 20, subfamily A, polypeptide 1
  ENST ID: ENST00000431118
  CDS Start-End: 37-171
gccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaacggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctactaaaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtaatcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcaggaggctgaggcaggagaatcatttgaacctgggaggcggagcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtagtcccagctgttctgaagg

SEQ ID NO: 124457 - DNA, 648 bp, Homo sapiens
  Payload ID: 4442
  Gene Symbol: CYP20A1
  Gene Name: cytochrome P450, family 20, subfamily A, polypeptide 1
  ENST ID: ENST00000428265
  CDS Start-End: 43-177
ggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaacggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaatgt

SEQ ID NO: 124458 - DNA, 1812 bp, Homo sapiens
  Payload ID: 4442
  Gene Symbol: CYP20A1
  Gene Name: cytochrome P450, family 20, subfamily A, polypeptide 1
  ENST ID: ENST00000429815
  CDS Start-End: 82-1494
gctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacattatgtatatttacctattttcaggtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaag

SEQ ID NO: 124459 - DNA, 804 bp, Homo sapiens
  Payload ID: 4442
  Gene Symbol: CYP20A1
  Gene Name: cytochrome P450, family 20, subfamily A, polypeptide 1
  ENST ID: ENST00000443941
  CDS Start-End: 29-804
gagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcag

SEQ ID NO: 124460 - DNA, 1730 bp, Homo sapiens
  Payload ID: 4442
  Gene Symbol: CYP20A1
  Gene Name: cytochrome P450, family 20, subfamily A, polypeptide 1
  ENST ID: ENST00000449301
  CDS Start-End: 87-713
cacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaa

SEQ ID NO: 124461 - DNA, 10854 bp, Homo sapiens
  Payload ID: 4442
  Gene Symbol: CYP20A1
  Gene Name: cytochrome P450, family 20, subfamily A, polypeptide 1
  Uniprot ID: Q6UW02
  ENST ID: ENST00000611416
  CDS Start-End: 615-1922
gtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacagagcactactaactcctaacttttctcagaaagctgggctctgctttcgccagcaacccggtccgaagtcgcgggcatattctgtctgaaatcgtgtgcaccgaaatccccgccttgcggtggaggctggcgctaggcggcctcagcctcggcctgctgcgctcaggaacccgcgccccggctcctcggcgatccattgctctttcctctggcgccggccgcaggcctcggtcacgcccccagcggcccgttggtttccgggtcccgcggggtgcccccgcccacacgctatgccttaaattgggccaggctgaggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacaccctcatgcaactggagtctgtttaaggaacatcataaaagaacgaaaaggaaggaacttcagtcaacatatttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctgggcgcggtggctcacacctgtaatccctacactttgggaggctgaggcaggtggatcacctgaggtccagagtttgagaccagtctggccaacatgatgaaaccccatctctactaaaaatacaaaacattggccgggagtggtggctcatgcctgtaatcccagcactttgggatgctgaggcgggtggatcacctgaggtcaggagtttgcgaccagcctggccaacatgatgaaaccctgtctctactaaaaatacaaaaaaattggctgggtgtggtggcccacacctgtaatcccagcactttgggaggtcgaggcgggtggatcacctgaggtccgaagttcgaggccagcctggccaacaggatgaaaccctgtctctattaaaaatacagaaaattggccgggtgcggtggctcacccctgtaatcccagtactttgggaggctgaggcgggtggagcacctgaggtcaggaattcgagatcagcctggccaacatggtgaaaccccatctctactgaaaaacacacacaaaaaaattagctgggcatggtggcacatgcctgtaatcccagctactcaggaggctgaggcaggagaatcatttgaacctgggaggcggagcttgcagtgagccgagattgcacccctgcactccagcctgggccacagagcaagactctgtctcaagaaaaacaaaaaaaaagataaatggacaaaagacatgaacaaacagcttttataggatagtatggctaacaaacttttagaaaagtgtttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaaattactgggcatggtgacacacacctgtagtcccagctgttctgaaggctgaggtgggaggatcacttgagaccaggagaggtcaaggctgcagtgatctgtgatcacaccactgcactccagcctgggcaacagagcaaaaccctgcctttaaaaaaacaaaaaacaaaaaaggccgggctcggtggctcatgcctataatactttgggaggccgaggcaggtggatcaattgaggtcaggtgttcgagaccagccaggccaacttggtgaaaccccgtctctactaaaaatacaaaaaaaaaaaaaaaaaattagccagatgtggtggtgcacatttgtaatcccagctactcaggaggctgaggcaggataatcgcttgaacctgggaggcagaggttgcagtgagccaagatcgcaccactgcactccagcctgggtgtcgagtgaaactcattctcaaaaaaaaaaaaaaaaggaggtggggagagctatttcaagaatattttaagtaggctgggcacggtagctcatgcctgttatcctaacactttgggaagccgacatgggcagatcacgaggtcaagagatttgagaccatcctggccaacatggtgaaaccccatctctactaaaaatacaaaaaattatctggacatgctggcgtgcgcctgtagtctcagctacttgggaggctgaggcaggagaatcgcttgaacctgggaggcggaggttgcagtgagctgatgttgtgctagtgcactccagcctgggcgacagggctgagaccttgtctcaaaaaaaaaaggagtatcttaagtgtctttcaaaattacactttagcacttataaattttatatataatactttactgatagcattgtatattagtccaacttttttggctacactatttgtgaaggattcctttttttctttaagacagccactgtaggaaatatgccaagtacagatagtgaggaaagaaaggaagaaaaatgataattgtctgcaagtgggcttatttttaacactgctgaatttcatttgtaattttactttcaagaatatactctggtagactgaggcgggaggatcacttgagcccaggagttggaggcttcagtgagctgtgatcacaccactgccctcagccaaacctgagtgataaagtgagaccctatctcttaaaaaaaaaaatccctttgttgttgagttattttatgtcatttattggtaaatacctaacattttagacctagtcattaccagttaacatagaatttaattggatgcagtctgtatttttgaaaaaaaaaattttttttggaataacttaaattctaaaactttggccgggcgtgatggctcatgcctgtaatcccagcactttgggaggccgaggcaggcagatcacctgaggtcaggcgttcaagaccagcctgaccaacatggagaaaccccgtctctactaaaaatacaaaattagccaggcttggtggtgcatgcctgtaataccagctactcgggaggctgaagcaggagaactgcttgaacctgggaggcagaggttgcggtgagccaagatcgcgccattgcactccagcctgggcaacaagagtgaaactccgtctcaaaaaaaaaagaaaaattctaaaactttaagtgaaatttattatcccttcccacttattttctgtggttttgtgtgtatagagcatcttcctttgttacccaagtacctcgaatgggttggaaactggcggtagaaggttagagtagccaattgatatgtaaaccaagtgtcagatcagatgagatgaaagaggtggagtttaaagcaagtgagatatgataaacaatgatgaaagcaaaaatagggcagttgaaccagagtcagccagttggcataactgccaataaatgaggcagtgtagaataactaataatgattggaatcaaggaaaagagagcatagaggaatcagctaaattagtatgttttatccatagttacatgactaacaaatgattaaaaagaagttattctctagataattttttaaataaaagtactgttaatatataaactaagttattcattcactgtttttcttcacagtaagaatgacaaaaatctgtgttctttgtacttatcaagtgactcaaattttggccacttcactgtcactgatggcttatagaatgattctagcaggactcaagttattgaactatcaaatgggtttttaattgatattgaagtaagtaagttttgtagcttttggagtttttaaaaactacttcagtgattttgatttatattctttttgatagttcagaagtgtattgttaaaaaacataagcatggccgggcacagtggctcacacctgtaatcccagctctttgggaggccaaggcgggtaaatcacctgaggttgggagtttgagaccagcctgaccaacatggagaaaccctgtctctaccaaaaatacaaaattagccgggcatgatggagcatccctgtaatcctagctacttgagacgctgaggcaggaaaattgcttgaacccgtgaggcagaggttgcgatgagccgagatcgtgccattgcactccagcctgggcaataagagcaaaactccgtctcagaaaaaaaaaaaaaaaaaaaaaacggccaggcgaggtggctcacacctgtaatcccagcactttgggaggctgaggcgggcagatcacctgaagtcaggagttcaagaccagcctgaccaacatggagaaacttcatctctactaaaaatacaaaattagccgggcgtggtggcacatgcctttaatcccagctactggggaggctgaaacaggagaatcgcttgaacccagtaggggaaggttgtggtgagccaagattgcaccattgcactccagcctgggcaagaagagtgaaactctatccaaaaaaaaaaaaaaaccatacgtacataactttttttctttttcttttctttctttcttttcttttcttttttttttttgaggcacagtcttgctttgttgaccaagctggagtgcattggcatgatcacagcttactgtagcctccacctcctgggctccagcgatctcacctcagcctctagaatagctgggactacatatgcatgccaccatgcccagctgtttttttgtttgcttgtttttggttttgtttttttgagacagggtctccctgcgtcgcccagtcttgtctcaaactcctaggctcaagcgatcctcccacctgggcctcccaaagtgttgagattgcaggtgtgagccacggcacctggtccataaaacatttttttatgaactaaagagctctctcaaacttgtgctaacaaaatttaaggcaatattaattctgtgcatgtgtttgggaaaattaaaaaaacttacatagtgcttatttggcccacaaaagtacagttccattttttatataaatagattctacctaacttataacccctatgtcaaaatttgtttatcttaaaatagtttgtataaaaagtctttactgctttattatgaaataataatgtttattgtagaaaaatctaggaaaacacaaaaatgtcaaactcagttaacagtcatagtttcactatttgaagttaaccactgttaagattcttttttttttttttttttttttgttttgagactgagtcccgctgtctattgcccaggctggagtgccatggcaccatctcggctcactgcaacctctgcttcccaggttcaagtgatcctcccgcctcagcctcccaagtagctgggattgcaaacatgtgccaccacacctggctaatttttgtgtttttagtacagatggggtttcaccatgttggccaggctggcctcgaactcctcaacctcaagtagtctgcccaccttgacctcccaaagtgctgggattacaggcatggggcaccatgcccagccccactgttaagattctaatgtaggccgggcacagtgactcatgcctataactcaagcactttgggagttcaaggcggccagattgcttgagcttttagaagtttgagaccagcctgggcaacgtggcaaaagcttgtttctataaaaaaatataaaaacttagccagccttggtggcaccacctgcagtcccaactattcaggaggctgaggcgagaggatggcttgagctcaggaagtcaaggctacagtgagctgtggtagtgccactgcactccctcatggttgacagagcaagaccctgtctcaaaagattctaatatagatactctttttatgcatatgtaatttatatatattatacaaaatattatttgcatttaacatattctgaaccaatagtcttttctacaagcagaacattagtattcttgtcactctgaatgtaggcacagatttttgtcattctttatcttttttgtgtgtgtgtgacagagtctcactgtcaccaggctggaatgcagtggcgtgatctcggctcactgcaacctctgcctcccaggttcaagcgattctcttgcctcagccttttgagtaactggggttacaggcgcgtgccatcacacccagctcatttttgtatttttagtagagatggggttttaccgtgttggtcaggctggtcctgaactcttgaccttgtgatctgcccaactcagcctcccagagtgctgggattacaagcatgagccaccgcgctcggtccctttctttttatttatttatttattttgagatggagtctcgctgtgtcacccaggctggagtgtggtggcacgatcttggctcactgcaacccctgcctcccaggttcaagcaattctcctgcctcagcctcctgagtagctgagactacgggtatgtgccactacactcagctaatttttgtatttttttttagtagagacagggtttcaccatgttggccaggctggtcttgaactcctaacctcaggtgattcacaccccttggcctcctgaagtgctgggattacaggcatgagccactgtgcccggccatttttttgtgtttttagtggagacaggttttcaccatgttggccagtagtgtatttagttatttaaggagggctcaatcaacaggtttaaatggtgtgctattcataattattgcaaaaataggccgggcctgtaattccagcactttgggaggccaaggcaggtgaatcacttgaggccaggagtttgagatcagcctggccaacgtggtgaaactccatctctactaaaaataccaaaagtagcgggcgtggtgacaggtgcctctaatcccagctactcgggaggctgaggcaggagaatcgcttgaacccaagagtcggaggttgcagtgagccgagatcgcgccattgcactccagtgtgggtgacgagcgaaaatccgtctcaaccaagaaaaaagaaaaaaagaaaaagaaaacttaactggcctttggggcacatgcctgtaatcccagcttcttgggaggctgaggcatgagaaaaaaaataaacctgggaggtggaggttgcagtgagttgagattgtgccactgcactccagcttaggcaataaaacaagactgtctcaaaaaaaaaaaaaaaaaaaacttattgagagaataatataccactaatatttaaagaaatttttggctggtgccgtggctcacacctgtaatcccagcactttgggagtccaaagtgggcgtataacttgaggtcaggagttcaagaacagcctggccaacatggggaaaccgcatctctactaaaaatacaaaaattagtgggtgtggaggcgggcgaatgtaatcccagctagttgagaggctgaggcaggagaatgtctgggaggtggaggttgcagtgtgccgagatcgcaccactgtactccagcctaggtgacagagtgagactccataggtctcagccagactctggaggtctcagcccaggcttgagtgcagtggcatgatctgggctcactacaacctccatctccccagttcaagcgattctcctgcctcagcctcccgagtagctgcgactacaggcgagtgcctccatgcccagctaattttttgtatttttagtagagacggggtttcaccatgttagccaggatggtcttgatctcctgaccttgtgatctgtccaccgcggcttcccaaagtgctgggattacaggtgtgagccacagcgcccggccaaaaaaaggaatttttaagaggaaaaagaatgctaccaacctaaacacatttctgtgactgtttatatttttccctgttccacatacatacatttttacatagtacgttcattgcagcatgagttacttttcacttaataaattttaaacattttccagctgggtgtggtggctcatgcctgtaatcccaacacttggagaggccaagtcaggcttattgggtgagtccaggtgtttgagactagcctaggcaacatggcgaaactgcatctctacaaaaaatacaaaaattagccaggtgtgctggcgcacacctgtagtcccaactactcaggaggctgaggtgggaggattgcttgagcccaggaggtagaggttgcagtgagccatgatcatgccactgcactccagcctaggtgacaaagcacaaccctcaaataaataaataaatacatgttaaacatatacctttattacttcatttttgtaagagcttcagggaataggcttttttaaagggaatagacttatagatcaattttaatatttgacttatagaattttatgacactaaatggataattgtaaagtttgagttgggacccattttttaagacattcaggctataaacaaggtaataaatcacactcttccagttctactcccaatttaattggtttacagttcggtggctgtctttttttttttttttttttttttttgagaccgagtctccctctgtcaccaggctggagtgcagtggtgcaatctcagctcactgcaacctccccctctcaggttcaagtaattctcctgcctcagcctgccgagtagctgggactacagtcgcacgccaaccacccccagctaatttttttatttttagtagagacaggatttcaccatgtttgccaggatggtctcgatctcttgtgctcataatctacctacctcggcctcccaaagtgctcggattacagacgtgagccactgcgcccggcccgttggcttgctttctagatactgggaatagatcttgttatagtatgtgataaatagatcttgttatagtatgtgataaaatgccatgatcaaataaattacttatatcctgtttggtgatttttagaaaaacatatttatctacatctaaaatacttattttaattttaaacacttgatggtatgaaatgaaattttgttactttaccattgtaactatgtcataaagtcataaagtacctgtccccaaaaaggcaaccagtaaatatttttgagtaaatgaatgaaatctttattgccggtgttctgtgcacatagaataaaggaaattattaatgtta

SEQ ID NO: 124462 - DNA, 1986 bp, Homo sapiens
  Payload ID: 4442
  Gene Symbol: CYP20A1
  Gene Name: cytochrome P450, family 20, subfamily A, polypeptide 1
  ENST ID: ENST00000613925
  CDS Start-End: 865-1443
ggcgctgctgctggagcggccgatccgagacgtggctccctgggcggcagaaccatgttggacttcgcgatcttcgccgttaccttcttgctggcgttggtgggagccgtgctctacctctatccggcttccagacaagctgcaggaattccagggattactccaactgaagaaaaagatggtaatcttccagatattgtgaatagtggaagtttgcatgagttcctggttaatttgcatgagagatatgggcctgtggtctccttctggtttggcaggcgcctcgtggttagtttgggcactgttgatgtactgaagcagcatatcaatcccaataagacatcggacccttttgaaaccatgctgaagtcattattaaggtatcaatctggtggtggcagtgtgagtgaaaaccacatgaggaaaaaattgtatgaaaatggtgtgactgattctctgaagagtaactttgccctcctcctaaagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtttggtctgagattggaaaaggctttctagatgggtcacttgataaaaacatgactcggaaaaaacaatatgaagatgccctcatgcaactggagtctgttttaaggaacatcataaaagaacgaaaaggaaggaacttcagtcaacatattttcattgactccttagtacaagggaaccttaatgaccaacagatcctagaagacagtatgatattttctctggccagttgcataataactgcaaaattgtgtacctgggcaatctgttttttaaccacctctgaagaagttcaaaaaaaattatatgaagagataaaccaagtttttggaaatggtcctgttactccagagaaaattgagcagctcagatattgtcagcatgtgctttgtgaaactgttcgaactgccaaactgactccagtttctgcccagcttcaagatattgaaggaaaaattgaccgatttattattcctagagagaccctcgtcctttatgcccttggtgtggtacttcaggatcctaatacttggccatctccacacaagtttgatccagatcggtttgatgatgaattagtaatgaaaactttttcctcacttggattctcaggcacacaggagtgtccagagttgaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaattttgtaaatttggatttttatatatcatattttcttaattcattgtacacatttgacttactgcacagtatattgatcattttaatgggaaactttagctttctactttttatttttgttttttcactttctatgccattatttttgtattctttttcttagtgtgagctctaaaatcaatgttcttgaaaaagaaattattttgcagaagttggggaatcatgtttgttgaatatgtataaaatagaaacataggctcggcctcccaaagtgctcggattacagacgtgagccactgcgcccggcccgttggcttgctttctagatactgggaatagatcttgttatagtatgtgataaatagatcttgttatagtatgtgataaaatgccatgatcaaataaattacttatatcctg

SEQ ID NO: 124463 - DNA, 1942 bp, Homo sapiens
  Payload ID: 4443
  Gene Symbol: CYP21A2
  Gene Name: cytochrome P450, family 21, subfamily A, polypeptide 2
  Uniprot ID: P08686
  ENST ID: ENST00000383321
  CDS Start-End: 9-1406
gtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 124464 - DNA, 2121 bp, Homo sapiens
  Payload ID: 4443
  Gene Symbol: CYP21A2
  Gene Name: cytochrome P450, family 21, subfamily A, polypeptide 2
  ENST ID: ENST00000383322
  CDS Start-End: 126-1613
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 124465 - DNA, 1939 bp, Homo sapiens
  Payload ID: 4443
  Gene Symbol: CYP21A2
  Gene Name: cytochrome P450, family 21, subfamily A, polypeptide 2
  ENST ID: ENST00000452708
  CDS Start-End: 9-1403
gtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 124466 - DNA, 1942 bp, Homo sapiens
  Payload ID: 4443
  Gene Symbol: CYP21A2
  Gene Name: cytochrome P450, family 21, subfamily A, polypeptide 2
  Uniprot ID: P08686
  ENST ID: ENST00000434026
  CDS Start-End: 9-1406
gtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctctggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcctcccgttccccttaaggaggtggctcccagcactcaaccaacctccccgcagagctcccttcctgaccctctgccgcagaggattgaggcttaatcctgagctggtcctttccagccaataaatcaactccagctccctctgcgaggctggcatgattgttccatttc

SEQ ID NO: 124467 - DNA, 2121 bp, Homo sapiens; identical to SEQ ID NO: 124464
  Payload ID: 4443
  Gene Symbol: CYP21A2
  Gene Name: cytochrome P450, family 21, subfamily A, polypeptide 2
  ENST ID: ENST00000456152
  CDS Start-End: 126-1613

SEQ ID NO: 124468 - DNA, 2114 bp, Homo sapiens
  Payload ID: 4443
  Gene Symbol: CYP21A2
  Gene Name: cytochrome P450, family 21, subfamily A, polypeptide 2
  Uniprot ID: P08686
  ENST ID: ENST00000448314
  CDS Start-End: 126-1610
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctc

SEQ ID NO: 124469 - DNA, 1942 bp, Homo sapiens; identical to SEQ ID NO: 124463
  Payload ID: 4443
  Gene Symbol: CYP21A2
  Gene Name: cytochrome P450, family 21, subfamily A, polypeptide 2
  Uniprot ID: P08686
  ENST ID: ENST00000452386
  CDS Start-End: 9-1406

SEQ ID NO: 124470 - DNA, 2118 bp, Homo sapiens
  Payload ID: 4443
  Gene Symbol: CYP21A2
  Gene Name: cytochrome P450, family 21, subfamily A, polypeptide 2
  Uniprot ID: P08686
  ENST ID: ENST00000436607
  CDS Start-End: 126-1610
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 124471 - DNA, 1939 bp, Homo sapiens; identical to SEQ ID NO: 124465
  Payload ID: 4443
  Gene Symbol: CYP21A2
  Gene Name: cytochrome P450, family 21, subfamily A, polypeptide 2
  ENST ID: ENST00000448877
  CDS Start-End: 9-1403

SEQ ID NO: 124472 - DNA, 2182 bp, Homo sapiens
  Payload ID: 4443
  Gene Symbol: CYP21A2
  Gene Name: cytochrome P450, family 21, subfamily A, polypeptide 2
  ENST ID: ENST00000418967
  CDS Start-End: 159-1646
ggtgtcattccagaaaagggccactctgtgggcgggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 124473 - DNA, 1914 bp, Homo sapiens
  Payload ID: 4443
  Gene Symbol: CYP21A2
  Gene Name: cytochrome P450, family 21, subfamily A, polypeptide 2
  Uniprot ID: P08686
  ENST ID: ENST00000435122
  CDS Start-End: 9-1406
gtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 124474 - DNA, 2121 bp, Homo sapiens
  Payload ID: 4443
  Gene Symbol: CYP21A2
  Gene Name: cytochrome P450, family 21, subfamily A, polypeptide 2
  ENST ID: ENST00000448478
  CDS Start-End: 126-1613
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctctggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcctcccgttccccttaaggaggtggctcccagcactcaaccaacctccccgcagagctcccttcctgaccctctgccgcagaggattgaggcttaatcctgagctggtcctttccagccaataaatcaactccagctccctc

SEQ ID NO: 124475 - DNA, 842 bp, Homo sapiens
  Payload ID: 4443
  Gene Symbol: CYP21A2
  Gene Name: cytochrome P450, family 21, subfamily A, polypeptide 2
  ENST ID: ENST00000466779
  CDS Start-End: 97-423
gtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctcccccacctcctcctgcagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctga

SEQ ID NO: 124476 - DNA, 580 bp, Homo sapiens
  Payload ID: 4443
  Gene Symbol: CYP21A2
  Gene Name: cytochrome P450, family 21, subfamily A, polypeptide 2
  ENST ID: ENST00000469053
  CDS Start-End: 8-244
tctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagcccccacctcctcctgcagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctt

SEQ ID NO: 124477 - DNA, 579 bp, Homo sapiens
  Payload ID: 4443
  Gene Symbol: CYP21A2
  Gene Name: cytochrome P450, family 21, subfamily A, polypeptide 2
  ENST ID: ENST00000471671
  CDS Start-End: 9-579
gtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggaggtgttaaaaacctggagcc

SEQ ID NO: 124478 - DNA, 599 bp, Homo sapiens
  Payload ID: 4443
  Gene Symbol: CYP21A2
  Gene Name: cytochrome P450, family 21, subfamily A, polypeptide 2
  ENST ID: ENST00000478281
  CDS Start-End: 42-599
agctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctttcccaccctccagcccccacctcctcctgcagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttac

SEQ ID NO: 124479 - DNA, 3262 bp, Homo sapiens
  Payload ID: 4444
  Gene Symbol: CYP24A1
  Gene Name: cytochrome P450, family 24, subfamily A, polypeptide 1
  Uniprot ID: Q07973
  ENST ID: ENST00000216862
  CDS Start-End: 395-1939
ggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgttgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatt

SEQ ID NO: 124480 - DNA, 1438 bp, Homo sapiens
  Payload ID: 4444
  Gene Symbol: CYP24A1
  Gene Name: cytochrome P450, family 24, subfamily A, polypeptide 1
  Uniprot ID: Q07973
  ENST ID: ENST00000395954
  CDS Start-End: 261-1379
ggacacctcaaaatccctgaacccaaattatctggacttcaactttttggtgcaatctttgactaggaggaaaggtgctttttcatcctattgtcaaactattgtcaaaagatgatcactattttatcccaaatattctgatgctaatattctctggctatttcttggcatgattctcagtgtttgtttgattttatggttcctgaagttgcagctggagtatttctgcatctccttcttttcttttcagtgtgctctaaatgtattcctgcttctctcacagggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgttgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagt

SEQ ID NO: 124481 - DNA, 2227 bp, Homo sapiens
  Payload ID: 4444
  Gene Symbol: CYP24A1
  Gene Name: cytochrome P450, family 24, subfamily A, polypeptide 1
  Uniprot ID: Q07973
  ENST ID: ENST00000395955
  CDS Start-End: 71-1417
ctagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgttgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtt

SEQ ID NO: 124482 - DNA, 2125 bp, Homo sapiens
  Payload ID: 4445
  Gene Symbol: CYP26A1
  Gene Name: cytochrome P450, family 26, subfamily A, polypeptide 1
  Uniprot ID: O43174
  ENST ID: ENST00000224356
  CDS Start-End: 46-1539
agcgctggcggcggcggcaggtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctacagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaatagtgcc

SEQ ID NO: 124483 - DNA, 2245 bp, Homo sapiens
  Payload ID: 4445
  Gene Symbol: CYP26A1
  Gene Name: cytochrome P450, family 26, subfamily A, polypeptide 1
  Uniprot ID: O43174
  ENST ID: ENST00000371531
  CDS Start-End: 379-1665
cggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctacagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaat

SEQ ID NO: 124484 - DNA, 1456 bp, Homo sapiens
  Payload ID: 4445
  Gene Symbol: CYP26A1
  Gene Name: cytochrome P450, family 26, subfamily A, polypeptide 1
  ENST ID: ENST00000624589
  CDS Start-End: 15-785
ggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataa

SEQ ID NO: 124485 - DNA, 4732 bp, Homo sapiens
  Payload ID: 4446
  Gene Symbol: CYP26B1
  Gene Name: cytochrome P450, family 26, subfamily B, polypeptide 1
  Uniprot ID: Q9NR63
  ENST ID: ENST00000001146
  CDS Start-End: 205-1743
aggcaatttttttcctccctctctccgctcccctcgcagcctccactccctttcccttggccccttcctccttctctgtttcggctggaggtgccaggacccccggccgcagcctcccctcccccgccgctccggtcccctcccgtcgggccctcccctcccccgccgcggccggcacagccaatcccccgagcggccgccaacatgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcagggttctggcttccagtcgtcgcggagggagaagtatggcaacgtgttcaagacgcatttgttggggcggccgctgatacgcgtgaccggcgcggagaacgtgcgcaagatcctcatgggcgagcaccacctcgtgagcaccgagtggcctcgcagcacccgcatgttgctgggccccaacacggtgtccaattccattggcgacatccaccgcaacaagcgcaaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggccacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccaggcagcggggtggtggttgtgggaggtagaaacctgtgtgtgggagggggccggaacggggagggcgagtggcccccatacttgccctcccttgctccccctccctggcaaaccctacccaaagccagtgggccccattcctagggctgggctccccttctggctccagcttccctccagccactccccatttaccatcagctcagcccctgggaagggcgtggcaggggctctgcatgcccgtgacagtgttaggtgtcagcgcgtgctacagtgtttttgtgatgttctgaactgctcccttccctccgttcctttcggacccttttagctggggttgggggacgggaagagccgtgcccccttgggcgcactcttcagcgtctcctcctcctgcgcccccactgcgtctgcccaggaacagcatcctgggtagcagaacaggagtcaaccttggcggggcgggggctgcgtccaacctggagattgcccttccctatgccacggttcccaccctccctcaccagtttggacaatttgaaattacctattgctgctacttgttctgtcctctgaccttggggcaaaggagccccaggccctgtctccccagcatcctccctggtggccctgggcaggtgcactgacacccccaccttcccatcccctgctgaaccaggccctgttacacacagccgcctaaggcccgcggctcatgtgctgcccgcccccatatttattcactgatagagaatcttggggatgctggggtctggagtgaacatctcctccccttcatgccctagcctgtgttctagctgtcctggcgagacttctgtgagtgaagaggaaggggtctctggtcaaacccagcccccagggcctagggttgaaagccttccccggctccgggcattatttgggtttaatctcggagcctcactcctggactgaagtccggtgcctctgccttatccctggtggagatggaatgtggcccattgcctcctccctctcctgtcaaaaaccctgatcaggtagatttggaggcggccacgatttcctgtttggcccctgttcaccccagtgcactggccctgactccaggcgtgagtatggggaaggatacgggttcttctgacggggagcaagggcctccgtcttcccttccttaactctccccctttgccctccgccctgaaaaaggtgtccttgaagtcccttccacctctatgccactgtctgcttagcccagctcaggggtggggaagaggcgaaagcgtgggggaggtgagcgcagcggcagttctgcctcggagctgattgcagggccctgtgtggtctccggacagctgcgggaaggctgccgcagctgaagctgaagaggcggctacgtgcggtttgtcagggggattgggttgaaaactggccagtcgggatgactgggtgaaagaggagtagctcctgccactggcgttttgagtgttggcaatttgggatgcctcctggggaaggtttccgggcgtttggtgagtctctagatttttccttgctttctgtgtttattggtttttgatgttgtaaaagcaatgaatcccctttacaagaaaatcgaaaacacagaagaatgaaggacatgccagtccccgatcgctgctgtgagcacctcagtggctccctcagaccagatcccgtaggcagccccacagaccgaccctgaccccactcacagccaccctgaagatagactataggaacgggcccataccacacagactgctctccaatccctgagtctcagatgtttcatttatttcctacttttccactactaaaaaacagtgtggaatagacattattggcaaaattgctcatccctaatcctgaaaaacaggccagaatgggtaaagacttgtcaaagcttgcaacatagctacatggtgcacccggacctgtaccccctccccccaacacaaaaccagtgtctgggaggttcattttcctttaaactgatccagctggccctgaaccaattgtttttgactgagtatctaggagagcagtaagtggaacttcagacaagcccactgggtctggtccaggtgaggggcagggggcatggggctgggaggtctcaggggccttccctgggggtggccagcctggtagggggcagagaaggaaaagctgaggggggtccctgtgagggaggaaagaaggatcatttgccccgctgggtctcaaaggcagtgagaagagagctgaagaaagctctggctggctgacaggatccctgtgttgtaattggtccctcctttcagctctctagtgagatgcccgtgtctgtgcgtgtgcgtgtgtgtttcatacagctagcattagatgggtgatgtttcttacttatcatccctaactattgcaacttgaccttaaaaagacaaaaccccacaaaactcttcctgccacgggcttgcagattgaagcactttcgatgttgggcgctggcgtttgtgttctgggcaccaccgtgaccctgcccagatggctataatattattttatacacaaaccttttttttcataaatgttataattttgtgtctgtctttataaactattataagtactatttttgttataattcaaaatagatatttagtataaagtttttgctgttaaatatttgttatttagtaaaatatgaattttgctctattgtaaacatggttcaaaatattaatatgtttttatcacagtcgttttaatattgaaaaagcacttgtgtgttttgttttgatatgaaactggtaccgtgtgagtgtttttgctgtcgtggttttaatctgtatataatattccatgttgcatattaaaaacatgaatgttgtgcattttgtgattttggaaatactcaatgtggctcttctataggcttctagaataaaccgtggggacccgc

SEQ ID NO: 124486 - DNA, 4025 bp, Homo sapiens
  Payload ID: 4446
  Gene Symbol: CYP26B1
  Gene Name: cytochrome P450, family 26, subfamily B, polypeptide 1
  ENST ID: ENST00000412253
  CDS Start-End: 226-1191
tccctgagcggtggcagaccggggaggtggggaggcggactccctccgtcaggggccgcatgtgctgtggtcttggcgaaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggccacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccaggcagcggggtggtggttgtgggaggtagaaacctgtgtgtgggagggggccggaacggggagggcgagtggcccccatacttgccctcccttgctccccctccctggcaaaccctacccaaagccagtgggccccattcctagggctgggctccccttctggctccagcttccctccagccactccccatttaccatcagctcagcccctgggaagggcgtggcaggggctctgcatgcccgtgacagtgttaggtgtcagcgcgtgctacagtgtttttgtgatgttctgaactgctcccttccctccgttcctttcggacccttttagctggggttgggggacgggaagagccgtgcccccttgggcgcactcttcagcgtctcctcctcctgcgcccccactgcgtctgcccaggaacagcatcctgggtagcagaacaggagtcaaccttggcggggcgggggctgcgtccaacctggagattgcccttccctatgccacggttcccaccctccctcaccagtttggacaatttgaaattacctattgctgctacttgttctgtcctctgaccttggggcaaaggagccccaggccctgtctccccagcatcctccctggtggccctgggcaggtgcactgacacccccaccttcccatcccctgctgaaccaggccctgttacacacagccgcctaaggcccgcggctcatgtgctgcccgcccccatatttattcactgatagagaatcttggggatgctggggtctggagtgaacatctcctccccttcatgccctagcctgtgttctagctgtcctggcgagacttctgtgagtgaagaggaaggggtctctggtcaaacccagcccccagggcctagggttgaaagccttccccggctccgggcattatttgggtttaatctcggagcctcactcctggactgaagtccggtgcctctgccttatccctggtggagatggaatgtggcccattgcctcctccctctcctgtcaaaaaccctgatcaggtagatttggaggcggccacgatttcctgtttggcccctgttcaccccagtgcactggccctgactccaggcgtgagtatggggaaggatacgggttcttctgacggggagcaagggcctccgtcttcccttccttaactctccccctttgccctccgccctgaaaaaggtgtccttgaagtcccttccacctctatgccactgtctgcttagcccagctcaggggtggggaagaggcgaaagcgtgggggaggtgagcgcagcggcagttctgcctcggagctgattgcagggccctgtgtggtctccggacagctgcgggaaggctgccgcagctgaagctgaagaggcggctacgtgcggtttgtcagggggattgggttgaaaactggccagtcgggatgactgggtgaaagaggagtagctcctgccactggcgttttgagtgttggcaatttgggatgcctcctggggaaggtttccgggcgtttggtgagtctctagatttttccttgctttctgtgtttattggtttttgatgttgtaaaagcaatgaatcccctttacaagaaaatcgaaaacacagaagaatgaaggacatgccagtccccgatcgctgctgtgagcacctcagtggctccctcagaccagatcccgtaggcagccccacagaccgaccctgaccccactcacagccaccctgaagatagactataggaacgggcccataccacacagactgctctccaatccctgagtctcagatgtttcatttatttcctacttttccactactaaaaaacagtgtggaatagacattattggcaaaattgctcatccctaatcctgaaaaacaggccagaatgggtaaagacttgtcaaagcttgcaacatagctacatggtgcacccggacctgtaccccctccccccaacacaaaaccagtgtctgggaggttcattttcctttaaactgatccagctggccctgaaccaattgtttttgactgagtatctaggagagcagtaagtggaacttcagacaagcccactgggtctggtccaggtgaggggcagggggcatggggctgggaggtctcaggggccttccctgggggtggccagcctggtagggggcagagaaggaaaagctgaggggggtccctgtgagggaggaaagaaggatcatttgccccgctgggtctcaaaggcagtgagaagagagctgaagaaagctctggctggctgacaggatccctgtgttgtaattggtccctcctttcagctctctagtgagatgcccgtgtctgtgcgtgtgcgtgtgtgtttcatacagctagcattagatgggtgatgtttcttacttatcatccctaactattgcaacttgaccttaaaaagacaaaaccccacaaaactcttcctgccacgggcttgcagattgaagcactttcgatgttgggcgctggcgtttgtgttctgggcaccaccgtgaccctgcccagatggctataatattattttatacacaaaccttttttttcataaatgttataattttgtgtctgtctttataaactattataagtactatttttgttataattcaaaatagatatttagtataaagtttttgctgttaaatatttgttatttagtaaaatatgaattttgctctattgtaaacatggttcaaaatattaatatgtttttatcacagtcgttttaatattgaaaaagcacttgtgtgttttgttttgatatgaaa

SEQ ID NO: 124487 - DNA, 567 bp, Homo sapiens
  Payload ID: 4446
  Gene Symbol: CYP26B1
  Gene Name: cytochrome P450, family 26, subfamily B, polypeptide 1
  ENST ID: ENST00000461519
  CDS Start-End: 50-567
gcattatttattatcctctaggccctacttcgcagttcttgtgcacgctatgaaaaataaaacctgcgtgctcgtctgtgtgagtgtgtttggtggggagagggggcaggtgactgtaccccgggttggggtccgccgcccctccctcgcgggccctctgcagaagtgcaccctgagagagacccgggtgtggctcccgcagggttctggcttccagtcgtcgcggagggagaagtatggcaacgtgttcaagacgcatttgttggggcggccgctgatacgcgtgaccggcgcggagaacgtgcgcaagatcctcatgggcgagcaccacctcgtgagcaccgagtggcctcgcagcacccgcatgttgctgggccccaacacggtgtccaattccattggcgacatccaccgcaacaagcgcaaggtcttctccaagatcttcagccacgaggccctggagagttacctgcccaagatccagctggtgatccaggacacactgcgcgcctggagcagccaccccgaggccatcaacgtgtaccaggaggcgcagaagctgacctt

SEQ ID NO: 124488 - DNA, 574 bp, Homo sapiens
  Payload ID: 4446
  Gene Symbol: CYP26B1
  Gene Name: cytochrome P450, family 26, subfamily B, polypeptide 1
  ENST ID: ENST00000474509
  CDS Start-End: 29-574
acagccaatcccccgagcggccgccaacatgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgc

SEQ ID NO: 124489 - DNA, 4331 bp, Homo sapiens
  Payload ID: 4446
  Gene Symbol: CYP26B1
  Gene Name: cytochrome P450, family 26, subfamily B, polypeptide 1
  Uniprot ID: Q9NR63
  ENST ID: ENST00000546307
  CDS Start-End: 29-1342
acagccaatcccccgagcggccgccaacatgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggccacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccaggcagcggggtggtggttgtgggaggtagaaacctgtgtgtgggagggggccggaacggggagggcgagtggcccccatacttgccctcccttgctccccctccctggcaaaccctacccaaagccagtgggccccattcctagggctgggctccccttctggctccagcttccctccagccactccccatttaccatcagctcagcccctgggaagggcgtggcaggggctctgcatgcccgtgacagtgttaggtgtcagcgcgtgctacagtgtttttgtgatgttctgaactgctcccttccctccgttcctttcggacccttttagctggggttgggggacgggaagagccgtgcccccttgggcgcactcttcagcgtctcctcctcctgcgcccccactgcgtctgcccaggaacagcatcctgggtagcagaacaggagtcaaccttggcggggcgggggctgcgtccaacctggagattgcccttccctatgccacggttcccaccctccctcaccagtttggacaatttgaaattacctattgctgctacttgttctgtcctctgaccttggggcaaaggagccccaggccctgtctccccagcatcctccctggtggccctgggcaggtgcactgacacccccaccttcccatcccctgctgaaccaggccctgttacacacagccgcctaaggcccgcggctcatgtgctgcccgcccccatatttattcactgatagagaatcttggggatgctggggtctggagtgaacatctcctccccttcatgccctagcctgtgttctagctgtcctggcgagacttctgtgagtgaagaggaaggggtctctggtcaaacccagcccccagggcctagggttgaaagccttccccggctccgggcattatttgggtttaatctcggagcctcactcctggactgaagtccggtgcctctgccttatccctggtggagatggaatgtggcccattgcctcctccctctcctgtcaaaaaccctgatcaggtagatttggaggcggccacgatttcctgtttggcccctgttcaccccagtgcactggccctgactccaggcgtgagtatggggaaggatacgggttcttctgacggggagcaagggcctccgtcttcccttccttaactctccccctttgccctccgccctgaaaaaggtgtccttgaagtcccttccacctctatgccactgtctgcttagcccagctcaggggtggggaagaggcgaaagcgtgggggaggtgagcgcagcggcagttctgcctcggagctgattgcagggccctgtgtggtctccggacagctgcgggaaggctgccgcagctgaagctgaagaggcggctacgtgcggtttgtcagggggattgggttgaaaactggccagtcgggatgactgggtgaaagaggagtagctcctgccactggcgttttgagtgttggcaatttgggatgcctcctggggaaggtttccgggcgtttggtgagtctctagatttttccttgctttctgtgtttattggtttttgatgttgtaaaagcaatgaatcccctttacaagaaaatcgaaaacacagaagaatgaaggacatgccagtccccgatcgctgctgtgagcacctcagtggctccctcagaccagatcccgtaggcagccccacagaccgaccctgaccccactcacagccaccctgaagatagactataggaacgggcccataccacacagactgctctccaatccctgagtctcagatgtttcatttatttcctacttttccactactaaaaaacagtgtggaatagacattattggcaaaattgctcatccctaatcctgaaaaacaggccagaatgggtaaagacttgtcaaagcttgcaacatagctacatggtgcacccggacctgtaccccctccccccaacacaaaaccagtgtctgggaggttcattttcctttaaactgatccagctggccctgaaccaattgtttttgactgagtatctaggagagcagtaagtggaacttcagacaagcccactgggtctggtccaggtgaggggcagggggcatggggctgggaggtctcaggggccttccctgggggtggccagcctggtagggggcagagaaggaaaagctgaggggggtccctgtgagggaggaaagaaggatcatttgccccgctgggtctcaaaggcagtgagaagagagctgaagaaagctctggctggctgacaggatccctgtgttgtaattggtccctcctttcagctctctagtgagatgcccgtgtctgtgcgtgtgcgtgtgtgtttcatacagctagcattagatgggtgatgtttcttacttatcatccctaactattgcaacttgaccttaaaaagacaaaaccccacaaaactcttcctgccacgggcttgcagattgaagcactttcgatgttgggcgctggcgtttgtgttctgggcaccaccgtgaccctgcccagatggctataatattattttatacacaaaccttttttttcataaatgttataattttgtgtctgtctttataaactattataagtactatttttgttataattcaaaatagatatttagtataaagtttttgctgttaaatatttgttatttagtaaaatatgaattttgctctattgtaaacatggttcaaaatattaatatgtttttatcacagtcgttttaatattgaaaaagcacttgtgtgttttgttttgatatgaaactggtaccgtgtgagtgtttttgctgtcgtggttttaatctgtatataatattccatgttgcatattaaaaacatgaatgttgtgcattttgtgattttggaaatactcaatgtggctcttctataggcttctagaataaaccgtggggacccgc

SEQ ID NO: 124490 - DNA, 1569 bp, Homo sapiens
  Payload ID: 4447
  Gene Symbol: CYP26C1
  Gene Name: cytochrome P450, family 26, subfamily C, polypeptide 1
  Uniprot ID: Q6V0L0
  ENST ID: ENST00000285949
  CDS Start-End: 1-1569
atgttcccttgggggctgagctgcctgtcagtgctgggggcggcgggcactgctctcctgtgcgcgggcctgctgctcagcctggcccagcacctctggaccctccgctggatgctgagccgggaccgggcctccaccctgcctctgcccaagggctccatggggtggcccttcttcggcgaaacgctgcactggttagttcagggctcgcgcttccacagttctcgccgagagcgctatgggacagtgttcaagacgcacctgctgggcaggccagtgatccgcgtgagcggcgcggagaacgtgcgcaccatcctgctgggcgagcaccgcctggtgcgcagccagtggccgcagagtgcgcacatcctgctgggctcgcacacactgctaggtgcggtcggcgagccgcaccggcggcggcgcaaggtcctggcgcgcgtgttcagccgcgccgcgctggagcgctacgtgccgcgcctgcagggggcgctgcggcatgaggtgcgctcctggtgcgcggcgggcgggccggtctcagtctacgacgcctccaaagcgctcaccttccgcatggccgcgcgcatcctgctggggttgcggctggacgaggcgcagtgcgccacgctggcccggaccttcgagcagctcgtggagaacctcttctcactgcctctggacgttcccttcagtggcctacgcaagggcatccgggcaagggaccagctgcatcggcacctggagggggccatttctgagaagcttcacgaggacaaggctgcagagccgggtgatgccctcgacctaatcattcacagtgcaagggagctgggccatgagccctccatgcaggagctgaaggagtcggctgtggagctcctcttcgccgccttcttcaccacggccagtgccagcacctcgctcgtcctgctgctactgcagcatccggcggccatcgccaagattcgggaggagctggtggcgcaggggctggggcgcgcgtgcggctgcgcgcccggggccgctgggggcagcgaggggcccccgcccgactgcggctgcgagcccgacctcagcctcgcggcgctgggccgtctgcgctacgtcgactgcgtggtcaaggaggtgctgcgcctcctgccgccagtgtccgggggctaccgcaccgccctgcgcaccttcgagctcgacggctaccagatccccaagggctggagcgtgatgtatagcatccgggacacgcacgagacggctgcggtgtaccgcagccctcccgaaggcttcgatccagagcgcttcggcgcagcgcgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctga

SEQ ID NO: 124491 - DNA, 4208 bp, Homo sapiens
  Payload ID: 4447
  Gene Symbol: CYP26C1
  Gene Name: cytochrome P450, family 26, subfamily C, polypeptide 1
  ENST ID: ENST00000624358
  CDS Start-End: 457-1365
gactggaggagggacaggtggggcgggggtctgcagaccaggttggcaacactggtgagttgctcttctttcgccctccttcccttcttctatccaaagggtgctgagcccgggaggaggtgggaggtgccccgcggagccgggagtgagcgttcccgaggcagcaggcaccttcgagagggactggcatttgggcccaggagccaggaaaaagtcctgagcgtgccggcctcgaggaaggcacgttccctaagggcgcacggtcactgcagtctttcaccgtccgtctgtttttagaacagagttctggcctgagcttataaatctcgggctttgcccccaaaccccaggccttttgcggacggaacaggtgagcactgcgcactgctcgcgccccggttcttgcgtcccctgctctccctgcgctctgagcggcctggcccccgcgggctcatcatgttcccttgggggctgagctgcctgtcagtgctgggggcggcgggcactgctctcctgtgcgcgggcctgctgctcagcctggcccagcacctctggaccctccgctggatgctgagccgggaccgggcctccaccctgcctctgcccaagggctccatggggtggcccttcttcggcgaaacgctgcactggttagttcagggctcgcgcttccacagttctcgccgagagcgctatgggacagtgttcaagacgcacctgctgggcaggccagtgatccgcgtgagcggcgcggagaacgtgcgcaccatcctgctgggcgagcaccgcctggtgcgcagccagtggccgcagagtgcgcacatcctgctgggctcgcacacactgctaggtgcggtcggcgagccgcaccggcggcggcgcaaggtcctggcgcgcgtgttcagccgcgccgcgctggagcgctacgtgccgcgcctgcagggggcgctgcggcatgaggtgcgctcctggtgcgcggcgggcgggccggtctcagtctacgacgcctccaaagcgctcaccttccgcatggccgcgcgcatcctgctggggttgcggctggacgaggcgcagtgcgccacgctggcccggaccttcgagcagctcgtggagaacctcttctcactgcctctggacgttcccttcagtggcctacgcaaggtacggccgccccggctccagaccttcctccgaggctccgcggcgcgggcgggcctcccagacccagacgggacgccctcggcgcaccccgcgcgtccgtcacctctgctgggaacggcggcagggcccgggggtgggaggcgttgtggcggtggcgtggcggtgggctctgggcctggcctctgtgctggttcgctggtgtgacctggggctggccacacgacctccgtgggacgcgcctgccgcgacgcgctccagcctgagcaagcgcgggccgccagagtttggggtctcggtggcaggcgtcctgccagtcggtcggactccttcccacagcggcgcccctggggccggcctccatcacctcttcggaagcccagatggctgcggaaccgaggagagcgtgagggctgcagatgagccccggtccagcccagcgccagccccggacccaggggtgtgggcgtcagctccaccagccctggacccgctaggtttcgggatcagagaactgctgcttctccagacttcagaacaatgggcaggacccggagagcagctaggatgccccatcccgccttttggtccccctattctgggacttcccactgtttgattccctggttttcagtcacctgcataaaaataatatgtgtaaaggatcatgctataggctgatcaccgtggatacgttttctgatctaatcctcgcagcctgcaaagtgttatgattctcattttattggccaaacttattttattgacttacccaagatcacaccgttagtaggggcacgaacaggactttaacctcatctcctccgactatggaactcaagtgctgaattacagtgctttccccgggggaatgcttttgctgcggctattccctgaactctggagaggcatcccctattgcccacgctcttacagaggctaatgcttacaaatccaatagtgtcctctaagtcagagctttgctgggtgcatcaaggtaccccagcctgagcctagtacagggaaagggcaatgggctgaccctagccgcactgggctctgtgccaggcatggacatggacagctgtgtgactctgggcaattgcttgacctctctgaacttcagcatcctctcctcaggatgacagtaactctgctgtggctcagagggggattgtgataatcaagacagaatgatgtttgtggacagtggacatatccccgaccatttactgagcccagccatatgccaggccaggagctaagctgggaagctgttaacacaaggatgttggcagagccagtgctgagaaggttttctggcaggtccctacaccaatgctgcatccccagagccacatcttgtgtggccccactttgaggcacaggcagtcctcaagatgaggggcaagaggagacctgggttccagtaatgactcagccacactcactacctctgcagccttcagcctccagccagccttgtcagtaggagaactgaaggagtcggctgtggagctcctcttcgccgccttcttcaccacggccagtgccagcacctcgctcgtcctgctgctactgcagcatccggcggccatcgccaagattcgggaggagctggtggcgcaggggctggggcgcgcgtgcggctgcgcgcccggggccgctgggggcagcgaggggcccccgcccgactgcggctgcgagcccgacctcagcctcgcggcgctgggccgtctgcgctacgtcgactgcgtggtcaaggaggtgctgcgcctcctgccgccagtgtccgggggctaccgcaccgccctgcgcaccttcgagctcgacggctaccagatccccaagggctggagcgtgatgtatagcatccgggacacgcacgagacggctgcggtgtaccgcagccctcccgaaggcttcgatccagagcgcttcggcgcagcgcgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaacccttgtaaggaagcgggcacgccgtgggcgcaaccctggcctggctttgggccatagaaaaaacacgcagaggatgcctgacggaaggccctctggcagctggcgtctggcttcgtgcgccttggccactctgccggtctcggcggaaactagcaactgtgggcacttccaggctcgaaagggctcaaggtcaccggattctgctggccacttcttaaaaggaaaaattcctaccttaagaaggcatttactcttgtcatgtatacagaggagaataggcacaccaacacgtctccaacgctggattattttcatgggaggttgagacataattagagaggtttgagatatttgtaccaaaaataggaaggccaagaaataaagtgtcttgggagcgg

SEQ ID NO: 124492 - DNA, 2286 bp, Homo sapiens
  Payload ID: 4448
  Gene Symbol: CYP27A1
  Gene Name: cytochrome P450, family 27, subfamily A, polypeptide 1
  Uniprot ID: Q02318
  ENST ID: ENST00000258415
  CDS Start-End: 428-2023
gccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattgga

SEQ ID NO: 124493 - DNA, 799 bp, Homo sapiens
  Payload ID: 4448
  Gene Symbol: CYP27A1
  Gene Name: cytochrome P450, family 27, subfamily A, polypeptide 1
  ENST ID: ENST00000411688
  CDS Start-End: 136-799
catgaaggaagaaggcatggcttagctaaaaggagaaatgtcccagaaacctccatactgacagccaggaagtagtctcagaggctttggattccaggaaagaagctggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactgg

SEQ ID NO: 124494 - DNA, 903 bp, Homo sapiens
  Payload ID: 4448
  Gene Symbol: CYP27A1
  Gene Name: cytochrome P450, family 27, subfamily A, polypeptide 1
  ENST ID: ENST00000445971
  CDS Start-End: 31-378
cccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccc

SEQ ID NO: 124495 - DNA, 2540 bp, Homo sapiens
  Payload ID: 4449
  Gene Symbol: CYP27B1
  Gene Name: cytochrome P450, family 27, subfamily B, polypeptide 1
  Uniprot ID: O15528
  ENST ID: ENST00000228606
  CDS Start-End: 211-1737
ttgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccatt

SEQ ID NO: 124496 - DNA, 976 bp, Homo sapiens
  Payload ID: 4449
  Gene Symbol: CYP27B1
  Gene Name: cytochrome P450, family 27, subfamily B, polypeptide 1
  ENST ID: ENST00000546567
  CDS Start-End: 506-976
ggcaggaaatgagtaaagaggaagggggctggaagacaggcgcaggccggtgcaggtttccgtaccccaagggggcagacgcaatccctctcctggccaccgcagccgaacgcgctccttcactgcagccagtcccgtcgagccgtccccaccttcccgatgcgcactctctcctcaaccctgcagggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagac

SEQ ID NO: 124497 - DNA, 702 bp, Homo sapiens
  Payload ID: 4449
  Gene Symbol: CYP27B1
  Gene Name: cytochrome P450, family 27, subfamily B, polypeptide 1
  ENST ID: ENST00000546609
  CDS Start-End: 1-702
ctaccttagctggacctcgtctcccagggattagagaaaagagcaggagtcctgggtcttcccagttgagactgctggagctgagacacagtactctcttaaagaaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttg

SEQ ID NO: 124498 - DNA, 4401 bp, Homo sapiens
  Payload ID: 4450
  Gene Symbol: CYP27C1
  Gene Name: cytochrome P450, family 27, subfamily C, polypeptide 1
  Uniprot ID: Q4G0S4
  ENST ID: ENST00000335247
  CDS Start-End: 132-1250
agtctccttgtgcgatctcccagacatgagagccctgctgggctttctggctcctcctccgtgcagagttgtcccgtcaggagccaggaggggcgacgctggctccgtgggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggagggtgagcgggggacttctcacatacctcttccttagccaggctctgacgctgcaggagatctacgccaacgtgactgagatgctgctggccggcgtcgacacgacgtccttcaccttgtcttggactgtgtacctcctggcaaggcacccagaagtgcagcagacggtgtaccgggagattgtgaagaatttaggggaaaggcatgttccaactgcagctgatgtccccaaggtcccgctggtcagagctctccttaaggaaaccctgaggctgtttccagtgctgccagggaacggccgggtcacccaggaagacctggttattggcgggtatctgattccgaaaggcacccagctggccctttgccactatgccacatcgtaccaggatgagaacttccctcgggccaaggagttccggcctgagcgctggctgcggaaaggagacttagatagagttgacaattttggatccatcccctttggtcatggggttcgcagctgcatagggcggagaattgcagaactggagattcacctcgtcgtgatccagttgcttcaacattttgagatcaaaacatcttctcagaccaatgctgttcatgcaaaaacccacgggctcctgacgccaggggggcccatccacgtgcgatttgttaacagaaagtaagcctagattttaaacctgggctgatgtagcagaccagctcgccgacacacagtgggtatttgtgttcgctgatcaccgtggagaaggaaagcgatgtcgctaaaggctgtcttgttatagactggcctcccaggtcctgggacacttgtaaatctttatgcaaagtaatgtaaaaaggttgctattttactggtgcataccagaagttgccctttctttgggggaaacagctgtttaaaaaccagtggcagtgaatttttatgcttcatacattgtgctagactcaatatttaatgactggcagtatcctgtgcatttacttgtacagggaaatggtggtttacttacaaattcagttcttcaatatatgttctctaatactggcatctgggctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgcacacctatggtcctagttactcggaagactgaggcaggaggatcgtttgagctcaggaggttgggtctgcagtgagctatctatgatggcaccactgcacttcagcctgggtgacagagtgagaccctttctcaaaaataaaataaaataaaataaaataaaataaaataaaataaaatggctgtataagaatacttttctctccacaacgagtgcttaattttctagtcataatgcctaatgaagttgactattagtttttatttggaagaaataaataataaataaataataaataaataaaaaagaaagctcctggtgaaatcaagaataatcagattttctaaccaaatctaaatacagagtagagcagacgtataagaactggaaatatgatgacgtaaaattttgttgcctaagttgtgagaagtaataaaacaggcagcatggaaaacaatgtaactttagaacatttttatttcaagggaaaataaatacataaatagagatgctacagatacaacaatatttttatcttgatggtgttgttttaaatatccacacaagaaccctcacccagttgtgtgcctgtgccaggctctctgggaagccgtggctccgggagtgctgggtcctgaggagttctgttgcctttcctgctgctcaccggttgctaagaggaaacaccgtgatttcctgatgctcttgccttgtcatcatgcctgaaacagcttattcccaattctgtaattccttttacataatccttctccaaaaattactttcttactaatatagaccatacagttttttttccatttagtaagtcactctgcaaaataacccttaagtaaatagacataatatccatttcacataccatttttgttaaagtatataataaagttgaaatctctgtgtggtagcagaataactctagtatgaatgctgtaaatgtacaggtaaatgtgaaattaggtcatattaactggccaagtgttggattgattactttgaggtagcagtatacgtatattaagttttataaactagatgaaattgcattctgtttgagactgaaatttaaaaatattgagaataactaagcgacttgaagtgacctcttattccctgggtatacatacagtgtgaccctctcgtgaagtgtggctctgcctggggatcagcacagggtgaatagcaaagtgcgggctgggggtagcacctgtgcccgctgctgagtctcactgaacaggaagggaagcagccagacacgggggcctcctggtgtgatgtagcaggaagtgcagggcgccacccaggaagcatccacgccaaagaaatggagattcagctggacaagtttctaggttcgctactggtttataggaaatatgtggtatacagggagatgtcaaaactccatgggggctgggcgtggtggctcacacctgtaatttcagcactctggggaggttgaggcaggaggattgcttgaggccaggagtttgagacaagcttgggcaacacagtgagatcctgtctactaaaaatcaaaaaacttagctgagtgtggtggtgcatgcctgtagtcctagctatttgggaggctgaggctggaggattgcttaagtctgggaggttgaggctgcagtgagctgtgatccgccattacactccagcctgggtgacagagcaagacttcataacaaacaaacacacaaacaaactccatggggatgcagtcagcaaaatccagaatagagtgaggtctataggaccaatgtctcgggtttccaacaaaacaaatacgtgacaggcaaaaaacaagaggaggggccaggcgaggtggctcatgcctgtaatcccagcactttgggaggccaaggcgggcggataacctgaggtcaggggttccagaccagcctggccaacatggtgaaaccccatctctactaaaaatacagaaattatccaggcatggtggcgggcttctgtaattccagctacttgggaggctgaggcaggagaattgcttgaacctgggaggcagtttgcagtgagctgagatcacgccactgcactccacctgggcaacaagaacgaaactccgtatctaaaaaaaacaaaaaccaaaaagcaaaaaaaaaaccaaggggagaggagaactgttacagatgaagcaatataggagacatattaaccaagtacaatgctggacttcgtttgaatcagattcaaataaaccacttgtaaaaagacatttaagagataatttttaaaaataaaataaaagccaaaaatattaattcttccaatgcatgaaaaaaagagagcaactcggggaaatttgaatgctgactgtgtgtatttgatgatatttgggaattactgttaatttttttgttgtgataatggtagttatgttt

SEQ ID NO: 124499 - DNA, 2092 bp, Homo sapiens
  Payload ID: 4450
  Gene Symbol: CYP27C1
  Gene Name: cytochrome P450, family 27, subfamily C, polypeptide 1
  Uniprot ID: Q4G0S4
  ENST ID: ENST00000409327
  CDS Start-End: 113-1231
agcctcgccgccatgccggggccgaggaccctcgccaacctggcggagttcttctgcagggacggcttcagccgcatccacgagatccagggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggagggtgagcgggggacttctcacatacctcttccttagccaggctctgacgctgcaggagatctacgccaacgtgactgagatgctgctggccggcgtcgacacgacgtccttcaccttgtcttggactgtgtacctcctggcaaggcacccagaagtgcagcagacggtgtaccgggagattgtgaagaatttaggggaaaggcatgttccaactgcagctgatgtccccaaggtcccgctggtcagagctctccttaaggaaaccctgaggctgtttccagtgctgccagggaacggccgggtcacccaggaagacctggttattggcgggtatctgattccgaaaggcacccagctggccctttgccactatgccacatcgtaccaggatgagaacttccctcgggccaaggagttccggcctgagcgctggctgcggaaaggagacttagatagagttgacaattttggatccatcccctttggtcatggggttcgcagctgcatagggcggagaattgcagaactggagattcacctcgtcgtgatccagttgcttcaacattttgagatcaaaacatcttctcagaccaatgctgttcatgcaaaaacccacgggctcctgacgccaggggggcccatccacgtgcgatttgttaacagaaagtaagcctagattttaaacctgggctgatgtagcagaccagctcgccgacacacagtgggtatttgtgttcgctgatcaccgtggagaaggaaagcgatgtcgctaaaggctgtcttgttatagactggcctcccaggtcctgggacacttgtaaatctttatgcaaagtaatgtaaaaaggttgctattttactggtgcataccagaagttgccctttctttgggggaaacagctgtttaaaaaccagtggcagtgaatttttatgcttcatacattgtgctagactcaatatttaatgactggcagtatcctgtgcatttacttgtacagggaaatggtggtttacttacaaattcagttcttcaatatatgttctctaatactggcatctgggctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgcacacctatggtcctagttactcggaagactgaggcaggaggatcgtttgagctcaggaggttgggtctgcagtgagctatctatgatggcaccactgcacttcagcctgggtgacagagtgagaccctttctcaaaaat

SEQ ID NO: 124500 - DNA, 2153 bp, Homo sapiens
  Payload ID: 4451
  Gene Symbol: CYP3A4
  Gene Name: cytochrome P450, family 3, subfamily A, polypeptide 4
  Uniprot ID: P08684
  ENST ID: ENST00000336411
  CDS Start-End: 185-1696
acaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagta

SEQ ID NO: 124501 - DNA, 2342 bp, Homo sapiens
  Payload ID: 4451
  Gene Symbol: CYP3A4
  Gene Name: cytochrome P450, family 3, subfamily A, polypeptide 4
  ENST ID: ENST00000354593
  CDS Start-End: 108-1169
aatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctcgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtcaattgattgagcaataagcct

SEQ ID NO: 124502 - DNA, 564 bp, Homo sapiens
  Payload ID: 4451
  Gene Symbol: CYP3A4
  Gene Name: cytochrome P450, family 3, subfamily A, polypeptide 4
  ENST ID: ENST00000415003
  CDS Start-End: 104-564
actgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatcttcacaatcgctgtgacttgatttctgtttcactttgtagatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaa

SEQ ID NO: 124503 - DNA, 1515 bp, Homo sapiens
  Payload ID: 4452
  Gene Symbol: CYP3A43
  Gene Name: cytochrome P450, family 3, subfamily A, polypeptide 43
  Uniprot ID: Q9HB55
  ENST ID: ENST00000222382
  CDS Start-End: 1-1515
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagtaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctga

SEQ ID NO: 124504 - DNA, 1349 bp, Homo sapiens
  Payload ID: 4452
  Gene Symbol: CYP3A43
  Gene Name: cytochrome P450, family 3, subfamily A, polypeptide 43
  Uniprot ID: Q9HB55
  ENST ID: ENST00000312017
  CDS Start-End: 1-1263
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctga

SEQ ID NO: 124505 - DNA, 1396 bp, Homo sapiens
  Payload ID: 4452
  Gene Symbol: CYP3A43
  Gene Name: cytochrome P450, family 3, subfamily A, polypeptide 43
  ENST ID: ENST00000342499
  CDS Start-End: 104-484
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaagatgagctt

SEQ ID NO: 124506 - DNA, 1709 bp, Homo sapiens
  Payload ID: 4452
  Gene Symbol: CYP3A43
  Gene Name: cytochrome P450, family 3, subfamily A, polypeptide 43
  Uniprot ID: Q9HB55
  ENST ID: ENST00000354829
  CDS Start-End: 104-1615
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaaga

SEQ ID NO: 124507 - DNA, 1313 bp, Homo sapiens
  Payload ID: 4452
  Gene Symbol: CYP3A43
  Gene Name: cytochrome P450, family 3, subfamily A, polypeptide 43
  ENST ID: ENST00000433277
  CDS Start-End: 68-358
cccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggcctttaggtccaatgggatttctgaaaagtgccttaagttttgctgaagatgaagaatggaagagaatacgaacattgctatctccagctttcaccagtgtaaaattcaaggaagtaagaaaataagatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatacagagtctcgctgtgttgcctaggccggagtgcatggtgcgatctgggctcactgaaacctccacctcctgggttcgagtgattctcctgcctcagcctcctgaggagctgggattacagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctgactttccctaaggacttccactttgttcaagaaagctgtatccca

SEQ ID NO: 124508 - DNA, 990 bp, Homo sapiens
  Payload ID: 4452
  Gene Symbol: CYP3A43
  Gene Name: cytochrome P450, family 3, subfamily A, polypeptide 43
  ENST ID: ENST00000415413
  CDS Start-End: 68-946
cccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatccca

SEQ ID NO: 124509 - DNA, 733 bp, Homo sapiens
  Payload ID: 4452
  Gene Symbol: CYP3A43
  Gene Name: cytochrome P450, family 3, subfamily A, polypeptide 43
  ENST ID: ENST00000444905
  CDS Start-End: 100-603
cccagcaaagagcagcacacagctgaaagaaaaactcagaagacagagctgaaaaagaaaactggtgatggatctcattccaaactttgccatggaaacatgggttcttgtggctaccagcctggtactcctctatatcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctgactttccctaaggacttccactttgttcaagaaagctgtatccca

SEQ ID NO: 124510 - DNA, 1633 bp, Homo sapiens
  Payload ID: 4452
  Gene Symbol: CYP3A43
  Gene Name: cytochrome P450, family 3, subfamily A, polypeptide 43
  Uniprot ID: Q9HB55
  ENST ID: ENST00000434806
  CDS Start-End: 1-753
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatacagagtctcgctgtgttgcctaggccggagtgcatggtgcgatctgggctcactgaaacctccacctcctgggttcgagtgattctcctgcctcagcctcctgaggagctgggattacagcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctga

SEQ ID NO: 124511 - DNA, 1279 bp, Homo sapiens
  Payload ID: 4452
  Gene Symbol: CYP3A43
  Gene Name: cytochrome P450, family 3, subfamily A, polypeptide 43
  ENST ID: ENST00000436834
  CDS Start-End: 74-244
gcacagcccagcaaagagcagcacacagctgaaagaaaaactcagaagacagagctgaaaaagaaaactggtgatggatctcattccaaactttgccatggaaacatgggttcttgtggctaccagcctggtactcctctatatggtctttggaattttgacagagaatgtaatgaaaaatacggagaaatgtggggcctttaggtccaatgggatttctgaaaagtgccttaagttttgctgaagatgaagaatggaagagaatacgaacattgctatctccagctttcaccagtgtaaaattcaaggaagtaagaaaataaggtgatttataattagaaacttaaaggatgaatctggagacaggtaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatacagagtctcgctgtgttgcctaggccggagtgcatggtgcgatctgggctcactgaaacctccacctcctgggttcgagtgattctcctgcctcagcctcctgaggagctgggattacagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctga

SEQ ID NO: 124512 - DNA, 1255 bp, Homo sapiens
  Payload ID: 4452
  Gene Symbol: CYP3A43
  Gene Name: cytochrome P450, family 3, subfamily A, polypeptide 43
  Uniprot ID: Q9HB55
  ENST ID: ENST00000417625
  CDS Start-End: 74-1255
gcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggaggtctctgaataagattcccagctgggcgtggtggctcacgcctgtaatcccagcactttgggaggctgaagcaggaggatcacctaaggtcaggagttcgagaccagctttgccaacatgggtctttggaattttgacagagaatgtaatgaaaaatacggagaaatgtggggcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctga

SEQ ID NO: 124513 - DNA, 328 bp, Homo sapiens
  Payload ID: 4452
  Gene Symbol: CYP3A43
  Gene Name: cytochrome P450, family 3, subfamily A, polypeptide 43
  ENST ID: ENST00000631161
  CDS Start-End: 104-328
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtggggaccctaa

SEQ ID NO: 124514 - DNA, 1720 bp, Homo sapiens
  Payload ID: 4453
  Gene Symbol: CYP3A5
  Gene Name: cytochrome P450, family 3, subfamily A, polypeptide 5
  Uniprot ID: P20815
  ENST ID: ENST00000222982
  CDS Start-End: 101-1609
gctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgta

SEQ ID NO: 124515 - DNA, 3320 bp, Homo sapiens
  Payload ID: 4453
  Gene Symbol: CYP3A5
  Gene Name: cytochrome P450, family 3, subfamily A, polypeptide 5
  ENST ID: ENST00000339843
  CDS Start-End: 103-222
ctgctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtgtacatattacctccctctcttgaccattccagttcctgagtaactcaccagccctctgatctataaagtcacaatccctgtgacctgatttctgtttcactttgtagatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggtatctcttccctgtttggaccacattacccttcatcatatgaagccttgggtggctcctgtgtgagactcttgctgtgtgtcacaccctaatgaactagaacctaaggttgctgtgtgtcgtacaactagggctccgttgtccccacacagaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaaggtaaaatctgatggtggttaaatgacgatgtttaggttttgataaatttagattttatacacatgatagagcatgtatctgtatttttaaaaataaagacagagaacttatgtttagaacaagagaagccatttggtagaaataaagaaggagattggggaaggagatgagaatgagtcagagagatagcatttaaaacttgaaatcaggcacaacaattagtatgtcatgatataaacagtattgagataaaattttaccacttctcttccctttaataaattgtcaaaggataaagtttcctgtttgaaaatatattttactggtattgtgctttcctcatatcacagattggtaaagaatcattttaagtccaagactcttattttacatattctgcaattaaaggtcctatgaggctacctgccgactgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatgagaaacagggagggcaaaggcgaaaaagcaattggacatgatagctagatttgtttcaggaaaacatcctgctttccaaggatttagatgaatgtttttgttcactggtgactcaggtaacacgtcttcaagaagccatagggaggttgagggagggaagtcaagaagggaggttgaggactgcacttttgatttacttctgacttcacgagtcactttctgccaaagaaatctctccttttgcttctagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatct

SEQ ID NO: 124516 - DNA, 1075 bp, Homo sapiens
  Payload ID: 4453
  Gene Symbol: CYP3A5
  Gene Name: cytochrome P450, family 3, subfamily A, polypeptide 5
  Uniprot ID: P20815
  ENST ID: ENST00000439761
  CDS Start-End: 101-523
gctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggatttgtgcaacgaccagcaccatcaagatgcagacccattccgtcaccatgtggctccctcctgctgtcctacagtcacaacatggagtttgtctttttctctgacaggttctatatcagagcaaacttttatttatttgaggaggccaatgtattaatatttccttttatggattgttcttttggtgttaagtctgaaaatcctttgcttagccctccttcctacattgctttttctaagagttatatagtttaacactttacaaaatgtaactctattacccattttgtgttaatatttgcataagttatgagatttagatcaaggttcattttctgtggactatggctgtccaaatgttccaacaccattttggaaaggtaggcatattgtcaaaactcagctgagtatattttgtgaatctatttcttattgtttactcctccactaataccacactgtggtgactctagtagctgtacagtaactcttaacatcatatagggcaattctttccactttattgatttatattttcagaatggctttagcttttcttgtcccttgcctttccataaaaattcagaataagcttgtaagtgtctacaaacaaacctgccataattttgataagaattaaagcagaggtgtccaat

SEQ ID NO: 124517 - DNA, 594 bp, Homo sapiens
  Payload ID: 4453
  Gene Symbol: CYP3A5
  Gene Name: cytochrome P450, family 3, subfamily A, polypeptide 5
  ENST ID: ENST00000456417
  CDS Start-End: 98-217
gtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactc

SEQ ID NO: 124518 - DNA, 1971 bp, Homo sapiens
  Payload ID: 4454
  Gene Symbol: CYP3A7
  Gene Name: cytochrome P450, family 3, subfamily A, polypeptide 7
  Uniprot ID: P24462
  ENST ID: ENST00000336374
  CDS Start-End: 4-1515
gtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttac

SEQ ID NO: 124519 - DNA, 2176 bp, Homo sapiens
  Payload ID: 4455
  Gene Symbol: CYP39A1
  Gene Name: cytochrome P450, family 39, subfamily A, polypeptide 1
  Uniprot ID: Q9NYL5
  ENST ID: ENST00000275016
  CDS Start-End: 205-1614
gaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtga

SEQ ID NO: 124520 - DNA, 2269 bp, Homo sapiens
  Payload ID: 4455
  Gene Symbol: CYP39A1
  Gene Name: cytochrome P450, family 39, subfamily A, polypeptide 1
  ENST ID: ENST00000619708
  CDS Start-End: 590-1483
ctgcccctccttgcattttttccgcgctggctgagattcaaagagaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtgaggacaggaatggtgtcttacattcatttctacactttattatgctcaggattgcaccttctttacagagtatattcaataaatgtatgttgattgatgtattgatttatattttaattaacctggaagcattgttttgactcaaagtgtttgcaattatagtttggcagataccatatttttgctaatgcatagaaacacaaatataacggtatgccaagacaa

SEQ ID NO: 124521 - DNA, 2530 bp, Homo sapiens
  Payload ID: 4456
  Gene Symbol: CYP4A11
  Gene Name: cytochrome P450, family 4, subfamily A, polypeptide 11
  Uniprot ID: Q02928
  ENST ID: ENST00000310638
  CDS Start-End: 33-1592
ggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttggatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctgaacttgctgcctcctcgctccttgctctcccaggatcaattgtatcttgagttaaaagaacctgctctccattatctcaagtagcagagcagatgctaaaccgtcacagctgtaaatcatgtgcttaatgcaacatgccctttcgacccccacattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaa

SEQ ID NO: 124522 - DNA, 1760 bp, Homo sapiens
  Payload ID: 4456
  Gene Symbol: CYP4A11
  Gene Name: cytochrome P450, family 4, subfamily A, polypeptide 11
  ENST ID: ENST00000371904
  CDS Start-End: 24-1586
agagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacaggagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccatacacctgtctccttcttcctgcctgcttgtctgttcctatattagtttcctattactgctgtaataaactatcacaatctcagtgatttt

SEQ ID NO: 124523 - DNA, 1725 bp, Homo sapiens
  Payload ID: 4456
  Gene Symbol: CYP4A11
  Gene Name: cytochrome P450, family 4, subfamily A, polypeptide 11
  ENST ID: ENST00000371905
  CDS Start-End: 32-1399
gggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggtgagacgtcctgtgtggtaattcgaatagaggaatgagggaagtctctggtcaaccctctgatctttgtgagcctgatgttcatatgtggcatcttcaggtgtgctcttaaatgttggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaa

SEQ ID NO: 124524 - DNA, 2108 bp, Homo sapiens
  Payload ID: 4456
  Gene Symbol: CYP4A11
  Gene Name: cytochrome P450, family 4, subfamily A, polypeptide 11
  ENST ID: ENST00000465874
  CDS Start-End: 44-691
agagagaggtaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggtgagacgtcctgtgtggtaattcgaatagaggaatgagggaagtctctggtcaaccctctgatctttgtgagcctgatgttcatatgtggcatcttcaggtgtgctcttaaatgttggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaattcaacttcagctgtttgcttttctcagttgtcaggaatagtaaactgtagatttctctccccccacacatcctcaatgcagcacactaccttccctatttaattcactagtctgtcgtagagatgaatcattgaagtctttgcatctgtttataatacagatgacctgcaagtcctacctttcaagtcatataagggagaggttaaggtagccctttgaagaaagttttacaacagtgtgtgtcatatcatacattcttctgtcttgcccaatgaaatttttactgcattatatagtgttcacatatttacatctattttcccgtttgacaaattctgtacatgccttgagatctttataccatagtcctgtaatccacttagcacaatattggccaaaaacataaaaatgtgaacagtacactgtcttggagagaaaagcccaataattatcatataacgcacaacatttgaagcctcctggtatgtgaaatataaaacacacttgaaattgcttttgagctggagaggaaaactccagaatggttgcggtggagatcattgtggcatcaggaatcgtcctgtgacatacacacaggcaaaaacgatataaattcttagtagaaacaaagtttgttcaaagaaataattatgtgactttttgaaacggtgagtccacttacacagaacaggctttaagaaaaagcttcctcctgaaactccttctccagcactggtctgtctatcccagcatgagaaagtcctcctaaacattgcctgcaaatcatgtcgctgccactagagaactggagagcattcctaaggtccatttctagctcagaattaatatttactctcagtgtatttcattatattttattcattttaaaacttaacatcattcaaatatagaagtatttcttaa

SEQ ID NO: 124525 - DNA, 1517 bp, Homo sapiens
  Payload ID: 4456
  Gene Symbol: CYP4A11
  Gene Name: cytochrome P450, family 4, subfamily A, polypeptide 11
  ENST ID: ENST00000468629
  CDS Start-End: 52-1185
gggtggtcagagagaggtaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcct

SEQ ID NO: 124526 - DNA, 2138 bp, Homo sapiens
  Payload ID: 4456
  Gene Symbol: CYP4A11
  Gene Name: cytochrome P450, family 4, subfamily A, polypeptide 11
  ENST ID: ENST00000475477
  CDS Start-End: 52-846
gggtggtcagagagaggtaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacagaccaagtgatccaactgaggaaggctcaactacagaaggagggggagctggagaagatcaagaggaagaggcatttggattttctggatatcctcctcttggccaaagaaccacctggaccagatgccctacaccaccatgtgcattaaggaggcactgaggctctacccaccggtgccaggcattggcagagagctcagcactcccgtcaccttccctgatgggcgctccttgcccaaaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttggatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctgaacttgctgcctcctcgctccttgctctcccaggatcaattgtatcttgagttaaaagaacctgctctccattatctcaagtagcagagcagatgctaaaccgtcacagctgtaaatcatgtgcttaatgcaacatgccctttcgacccccacattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaa

SEQ ID NO: 124527 - DNA, 1133 bp, Homo sapiens
  Payload ID: 4456
  Gene Symbol: CYP4A11
  Gene Name: cytochrome P450, family 4, subfamily A, polypeptide 11
  ENST ID: ENST00000474458
  CDS Start-End: 52-801
gggtggtcagagagaggtaggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacagaccaagtgatccaactgaggaaggctcaactacagaaggagggggagctggagaagatcaagaggaagaggcatttggattttctggatatcctcctcttggccaaagtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcct

SEQ ID NO: 124528 - DNA, 1775 bp, Homo sapiens
  Payload ID: 4456
  Gene Symbol: CYP4A11
  Gene Name: cytochrome P450, family 4, subfamily A, polypeptide 11
  ENST ID: ENST00000462347
  CDS Start-End: 32-1297
gggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacagaccaagtgatccaactgaggaaggctcaactacagaaggagggggagctggagaagatcaagaggaagaggcatttggattttctggatatcctcctcttggccaaagggcccctggtctgcccaggccttgctggtgttcaggatggaattgtttcaggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttggatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctgaacttgctgcctcctcgctccttgctctcccaggatcaa

SEQ ID NO: 124529 - DNA, 1725 bp, Homo sapiens
  Payload ID: 4457
  Gene Symbol: CYP4A22
  Gene Name: cytochrome P450, family 4, subfamily A, polypeptide 22
  ENST ID: ENST00000294337
  CDS Start-End: 32-1399
gggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacaggaattctcagtcctacatccaggccattagtgacctgaacagcctggttttttgctgtatgaggaatgcctttcatgagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcacttggattttctggacatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccatggcctcctgggtgatggagcctccatcacctggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggtgagacgtcctgtgtggtaattggaatagagaaatgagggaagtctctggtcaaccctctgatctttgtgagcccgatgttcatatgtggcatcttcaggtgtgctcttaaatattggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaa

SEQ ID NO: 124530 - DNA, 1780 bp, Homo sapiens
  Payload ID: 4457
  Gene Symbol: CYP4A22
  Gene Name: cytochrome P450, family 4, subfamily A, polypeptide 22
  ENST ID: ENST00000371890
  CDS Start-End: 37-1302
ggaaggggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacagaccaagtgatccaactgaggaaggctcaactacagaaggagggggagctggagaagatcaagaggaagaggcacttggattttctggacatcctcctcttggccaaagggcccctggtctgcccaggccttgctggtgttcaggatggaattgtttcaggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggaactgcatcgggaaacaatttgccatgaaccagctgaaggtggccagggccctgaccctgctccgctttgagctgctgcctgatcccaccaggatccccatccccatggcacgacttgtgttgaaatccaaaaatggaatccacctgcgtctcaggaggctccctaacccttgtgaagacaaggaccagctttgagggcctccacctgccatcctgtcttcctgacccccactcctatctcctgcctgtctgcctctgtcctgctttctgtctgcccaccttcccttcttcccacctgcctgctgtcccccagtctgcctgcccttctctctctcacctttctccaagctccctacctgcttgtctacctgtctcctacccacctgtatatcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctcctcgctccttgctctcccaggatcaa

SEQ ID NO: 124531 - DNA, 2535 bp, Homo sapiens
  Payload ID: 4457
  Gene Symbol: CYP4A22
  Gene Name: cytochrome P450, family 4, subfamily A, polypeptide 22
  Uniprot ID: Q5TCH4
  ENST ID: ENST00000371891
  CDS Start-End: 32-1591
gggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacaggaattctcagtcctacatccaggccattagtgacctgaacagcctggttttttgctgtatgaggaatgcctttcatgagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcacttggattttctggacatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccatggcctcctgggtgatggagcctccatcacctggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggaactgcatcgggaaacaatttgccatgaaccagctgaaggtggccagggccctgaccctgctccgctttgagctgctgcctgatcccaccaggatccccatccccatggcacgacttgtgttgaaatccaaaaatggaatccacctgcgtctcaggaggctccctaacccttgtgaagacaaggaccagctttgagggcctccacctgccatcctgtcttcctgacccccactcctatctcctgcctgtctgcctctgtcctgctttctgtctgcccaccttcccttcttcccacctgcctgctgtcccccagtctgcctgcccttctctctctcacctttctccaagctccctacctgcttgtctacctgtctcctacccacctgtatatcttgttgggagaaaagctgagtgttgggagaagctgaggccgagcttgcatgtctgacataatgtaaaagagtcttgaatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctggacttgctggctcctcgctccttgctctcccaggatcaattgtatcttgagttaaaagaacctgctctccattatctcaagtaacagagcagatgctaaaccgtcacagctgtaaatcatgtgcttaatgcaacatgccctttcgacccaccccccattctcaccacctgtttctttgtttgatcaccaataaataatctgcacttccagagctcggggccttcacagcctccatacttagctttggcgccctggacccactttctctctcaaactgtcttttctcattcctttgactctgccggactttgtcacccccacaacctggtgttgggtccgataaccccaacatccctgaatctccacccacctcccaaactcctgcctgccctccagactgtctgcccatacacctgtctccttcttcctgcctgcttgtctgttcctatattagtttcctattgctgctgtaataaactatcacaatctcagtgattttaaataa

SEQ ID NO: 124532 - DNA, 1760 bp, Homo sapiens
  Payload ID: 4457
  Gene Symbol: CYP4A22
  Gene Name: cytochrome P450, family 4, subfamily A, polypeptide 22
  ENST ID: ENST00000620131
  CDS Start-End: 24-1586
agagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacaggaattctcagtcctacatccaggccattagtgacctgaacagcctggttttttgctgtatgaggaatgcctttcatgagaatgacaccatctacagcctgacctctgctggccgctggacacaccgcgcctgccagctggcccatcagcacacaggagaccaagtgatccaactgaggaaggctcaactacagaaggagggggagctggagaagatcaagaggaagaggcacttggattttctggacatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccatggcctcctgggtgatggagcctccatcacctggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggaactgcatcgggaaacaatttgccatgaaccagctgaaggtggccagggccctgaccctgctccgctttgagctgctgcctgatcccaccaggatccccatccccatggcacgacttgtgttgaaatccaaaaatggaatccacctgcgtctcaggaggctccctaacccttgtgaagacaaggaccagctttgagggcctccacctgccatcctgtcttcctgacccccactcctatctcctgcctgtctgcctctgtcctgctttctgtctgcccatacacctgtctccttcttcctgcctgcttgtctgttcctatattagtttcctattgctgctgtaataaactatcacaatctcagtgatttt

SEQ ID NO: 124533 - DNA, 2351 bp, Homo sapiens
  Payload ID: 4457
  Gene Symbol: CYP4A22
  Gene Name: cytochrome P450, family 4, subfamily A, polypeptide 22
  ENST ID: ENST00000619754
  CDS Start-End: 33-1106
ggggcactcagagatccagcaggtgctgcaccatgagtgtctctgtcctgagccccagcagacgcctgggtggtgtctccgggatcctccaagtgacctccctgctcattctgcttctgctgctgatcaaggcagctcagctctacctgcataggcagtggctgctcaaagccctccagcagttcccgtgccctccctcccactggctcttcgggcacatccaggagttccaacacgaccaggagctacaacggattcaggaacgggtgaagacattcccaagtgcctgtccttattggatatggggaggcaaagttcgtgtccagctctatgaccctgactatatgaaggtgattctggggagatcagacccgaaatcccatggatcctacaaattcctggctccacggattgggtacggcttgctcctgttgaatgggcagacatggttccagcatcgacggatgctgaccccagccttccacaatgacatcctgaagccatacgtggggctcatggcagactctgtacgagtgatgctggacaaatgggaagagctccttggccaggattcccctctggaggtctttcagcacgtctccttgatgaccctggacaccatcatgaagagtgccttcagccatcagggcagcatccaggtggacagaccaagtgatccaactgaggaaggctcaactacagaaggagggggagctggagaagatcaagaggaagaggcacttggattttctggacatcctcctcttggccaaagggcccctggtctgcccaggccttgctggtgttcaggatggaattgtttcaggaaccacctggaccagatgccctacaccaccatgtgcattaaggaggcactgaggctctacccaccggtgccaggcattggaagagagctcagcactcccgtcaccttccctgatgggcgctccttgcccaaaggtatcatggtcctcctctccatttatggccttcaccacaacccaaaagtgtggcccaacctagaggtgtttgacccttcccgttttgcaccgggttctgctcaacacagccacgctttcctgcccttctcaggaggatcaaggtgagacgtcctgtgtggtaattggaatagagaaatgagggaagtctctggtcaaccctctgatctttgtgagcccgatgttcatatgtggcatcttcaggtgtgctcttaaatattggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaattcaacttcagctgtttgcttttctcagttgtcaggaatagtaaactgtagatttctctctccccacacatcctcaatgcagcacactaccttccctatttaattcactagtctgtcgtagagatgaatcattgaaatctttgcatctgtttataatacagatgacctgcaagtcctacctttcaagccatataagggagaggttaaggtagccctttgaagaaagttttacaacagtgtgtgtcatatcatacatttttctgtcttgcccaatgacatttttacttcattatatagtgttcacatatttacatctatttccccatttggcaaattctgtacatgccttgagatctttataccatagtcctgtaatccacttagcacaatattggccaaaaacataaaaatgtgaacagtacactgtcttggagagaaaagcccaataattatcatataacgcacaacatttgaagcctcctggtatgtgaaatataaaacacacttgaaatagctattgagctggagaggaaaactccagaatggctgcggtggaaatcatcgtggcatcaggaatcgtcctgtgacatacacacaggcaaaaatgataaaaattcttagtagaaacaaagtttgttcaaagaaataattatgtgacttcttcaaatggtgagtccacttacatggaacaggaaagcttcctcctgaaactccttctccagcactggtctgtctatcccagcatgaggaagtccttgtaaacattgcctgcaaatcatgtcgctgccactagagaaccggagagcattcctaagctccatttctagctcagaactaatattttactctcagtgtatttcattctattttattcattttaaaacttaaataacatcattcaaatattaaagtatttctt

SEQ ID NO: 124534 - DNA, 2171 bp, Homo sapiens
  Payload ID: 4458
  Gene Symbol: CYP4B1
  Gene Name: cytochrome P450, family 4, subfamily B, polypeptide 1
  Uniprot ID: P13584
  ENST ID: ENST00000271153
  CDS Start-End: 37-1572
aggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcagactctcttgtaaccatcactgaagtcaagaaatatggaatatggtatcactgatgtgtcttctgc

SEQ ID NO: 124535 - DNA, 1494 bp, Homo sapiens
  Payload ID: 4458
  Gene Symbol: CYP4B1
  Gene Name: cytochrome P450, family 4, subfamily B, polypeptide 1
  ENST ID: ENST00000371919
  CDS Start-End: 1-1494
atggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtag

SEQ ID NO: 124536 - DNA, 2110 bp, Homo sapiens
  Payload ID: 4458
  Gene Symbol: CYP4B1
  Gene Name: cytochrome P450, family 4, subfamily B, polypeptide 1
  Uniprot ID: P13584
  ENST ID: ENST00000371923
  CDS Start-End: 37-1575
aggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcaga

SEQ ID NO: 124537 - DNA, 2019 bp, Homo sapiens
  Payload ID: 4458
  Gene Symbol: CYP4B1
  Gene Name: cytochrome P450, family 4, subfamily B, polypeptide 1
  ENST ID: ENST00000464439
  CDS Start-End: 19-996
gtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtagctctgatgagaatggggtcccagatggctcaggctgtgacctccctgggcaccaccctccccaggctgggtgtggaggagttggggccccctgccttcaggaggcttgtagtttagaagggaagtaggcattaccatagacgactcctagaggacagtgctatgtaaaaatgtgtgtctataaatgtttatcatgcatgtattctagagctcattcatttattcaacaaacatttggtgagcacctatttcgttcgagaaacttcatttatctcctataattggcaaacttaaaaatgcagcagaaacttacattccaaccttagagactcatagtgagcacaaggaaagttttgccctgagattcatggttatggctgggtaccaccaaatagaagaatggcttaggggagtgccccttcactgagatgtgtttctttgttgaactttgtgtgtgtgtgtttagaatataacagacataagaaaaaattacctaaatgaagactgtacaaaataataaataattctgaagcaga

SEQ ID NO: 124538 - DNA, 1289 bp, Homo sapiens
  Payload ID: 4458
  Gene Symbol: CYP4B1
  Gene Name: cytochrome P450, family 4, subfamily B, polypeptide 1
  ENST ID: ENST00000534708
  CDS Start-End: 85-348
aagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaag

SEQ ID NO: 124539 - DNA, 561 bp, Homo sapiens
  Payload ID: 4458
  Gene Symbol: CYP4B1
  Gene Name: cytochrome P450, family 4, subfamily B, polypeptide 1
  ENST ID: ENST00000526297
  CDS Start-End: 351-561
cttctggagaaaaaacaagccgtcccagaacttccagtcctatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagcagggacagcagctactaccttgcagtcagcgatctcactctgttgatgcagcagcgccttgtgtccttccagtaccata

SEQ ID NO: 124540 - DNA, 1375 bp, Homo sapiens
  Payload ID: 4458
  Gene Symbol: CYP4B1
  Gene Name: cytochrome P450, family 4, subfamily B, polypeptide 1
  ENST ID: ENST00000529715
  CDS Start-End: 32-448
agatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggggggatgcgtgtcctttgtctcacatctggcaatgtcatctgacacaagttcctggacccaggctttgtgggtgcagctgagatacagaaactgagttatcctgtcctaaggaaggagctcactcagccaagaactgctgccacctgtctcctgaggtcctggtagcctaggggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccgggatgaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtggtgagtctgagggtgggcccggtttatcctgctcagcccttgggaagggcgatgcccatcctgtcctgaaccatcctggaaatcaggtgaggtggcggctgctatcctgttacccccagtgtcataccttttgtggtggtggggggt

SEQ ID NO: 124541 - DNA, 1534 bp, Homo sapiens
  Payload ID: 4458
  Gene Symbol: CYP4B1
  Gene Name: cytochrome P450, family 4, subfamily B, polypeptide 1
  ENST ID: ENST00000614163
  CDS Start-End: 1-888
atggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacatgccctcgagatccaggagacggggagcctggacaaagtggtgtcctgggcccaccagttcccgtatgcccacccactctggttcggacagttcattggcttcctgaacatctatgagcctgactatgccaaagctgtgtacagccgtggggaccctaaggcccctgatgtgtatgacttcttcctccagtggattgggagaggcctgctggttcttgaggggcccaagtggttgcagcaccgcaagctgctcacacctggctttcattatgatgtgctgaagccctatgtggccgtgttcactgagtctacacgtatcatgctggacaagtgggaagagaaagctcgggagggtaagtcctttgacatcttctgcgatgtgggtcacatggcgctgaacacactcatgaagtgcacctttggaagaggagacaccggcctgggccacagggacagcagctactaccttgcagtcagcgatctcactctgttgatgcagcagcgccttgtgtccttccagtaccataatgacttcatctactggctcaccccacatggccgccgcttcctgcgggcctgccaggtggcccatgaccatacagaccaggtcatcagggagcggaaggcagccctgcaggatgagaaggtgcggaagaagatccagaaccggaggcacctggacttcctggacattctcctgggtgcccggggaagatgacatcaaactgtcagatgcagacctccgggctgaagtggacacattcatgtttgaaggccatgacaccaccaccagtggtatctcctggtttctctactgcatggccctgtaccctgagcaccagcatcgttgtagagaggaggtccgcgagatcctaggggaccaggacttcttccagtgggatgatctgggcaaaatgacttatctgaccatgtgcatcaaggagagcttccgcctctacccacctgtgccccaggtgtaccgccagctcagcaagcctgtcacctttgtggatggccggtctctacctgcaggaagcctgatctctatgcatatctatgccctccataggaacagtgctgtatggcccgaccctgaggtctttgactctctgcgcttttccactgagaatgcatccaaacgccatccctttgcctttatgcccttctctgctgggcccaggaactgcattgggcagcagtttgccatgagtgagatgaaggtggtcacagccatgtgcttgctccgctttgagttctctctggacccctcacggctgcccatcaagatgccccagcttgtcctgcgctccaagaatggctttcacctccacctgaagccactgggccctgggtctgggaagtag

SEQ ID NO: 124542 - DNA, 2977 bp, Homo sapiens
  Payload ID: 4459
  Gene Symbol: CYP4F11
  Gene Name: cytochrome P450, family 4, subfamily F, polypeptide 11
  Uniprot ID: Q9HBI6
  ENST ID: ENST00000248041
  CDS Start-End: 38-1612
agaggcaaagacctcctagcagagggggagaggagggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggatcta

SEQ ID NO: 124543 - DNA, 2877 bp, Homo sapiens
  Payload ID: 4459
  Gene Symbol: CYP4F11
  Gene Name: cytochrome P450, family 4, subfamily F, polypeptide 11
  ENST ID: ENST00000326742
  CDS Start-End: 3-1367
ggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggatcta

SEQ ID NO: 124544 - DNA, 3161 bp, Homo sapiens
  Payload ID: 4459
  Gene Symbol: CYP4F11
  Gene Name: cytochrome P450, family 4, subfamily F, polypeptide 11
  Uniprot ID: Q9HBI6
  ENST ID: ENST00000402119
  CDS Start-End: 428-2002
gagggtatgtgggacaagctgcttctgataggagccaggctggcagtggcagggctggagggtcctggcctgggatggggaggggactgcccaaggttggggtgggtcaaggctgctggcctgggagactggtgatttcctggtaactggacccctggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattg

SEQ ID NO: 124545 - DNA, 2531 bp, Homo sapiens
  Payload ID: 4459
  Gene Symbol: CYP4F11
  Gene Name: cytochrome P450, family 4, subfamily F, polypeptide 11
  ENST ID: ENST00000591841
  CDS Start-End: 1139-1738
tgagatattatttgagtcttagtatagttaggtcttagggtagatttgaattatgccgaagaataggcttggttatacccgggccatgtttaggacattagtgacatcatatttaaatgttatctaggacccttcactgggatacacagaagtcatatcagaccatctcaggtccatggcagagcatgttgtgtcatttagggtttgtcatatgtgttttggccatgtcagggaatgttaacaactgtcggggcaatattccaggtcccagatccatgtcagaagatagcagagagtgctgggagtagacagagtgtcctaggtccctgtaaaggcattctgtagagtgttgagctatgctcaggtgttgcagaacatgttggaccttgtaggagatatgtcactgtgtgctggggcatgctgtgttattgctctactctgtcgctgcagcctggtctggtctctccttcctccaccatcctcccttcttcctctacccttggccttcttcctgctatgctgggtgggatgcgtggaagtgcacacccctggctgggagcattcctccatacccaaagtccttctctcacccctctccatggccactgatggtcctcaatcatgtcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaag

SEQ ID NO: 124546 - DNA, 2908 bp, Homo sapiens
  Payload ID: 4459
  Gene Symbol: CYP4F11
  Gene Name: cytochrome P450, family 4, subfamily F, polypeptide 11
  ENST ID: ENST00000620614
  CDS Start-End: 37-1401
gaggcaaagacctcctagcagagggggagaggagggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggat

SEQ ID NO: 124547 - DNA, 1687 bp, Homo sapiens
  Payload ID: 4460
  Gene Symbol: CYP4F12
  Gene Name: cytochrome P450, family 4, subfamily F, polypeptide 12
  ENST ID: ENST00000324632
  CDS Start-End: 53-1627
agctcttccctgggcctcaggtcctcaccctgcatcccctctgccctgcaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacc

SEQ ID NO: 124548 - DNA, 2860 bp, Homo sapiens
  Payload ID: 4460
  Gene Symbol: CYP4F12
  Gene Name: cytochrome P450, family 4, subfamily F, polypeptide 12
  Uniprot ID: Q9HCS2
  ENST ID: ENST00000517734
  CDS Start-End: 48-356
agaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacgctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggtaggtttctctatgatctgaatttaggtgagagaatagagcttcatgtcaaatgtcaggtgaaataaattggttttgatccaaagggcactgggagccatggaagatgcttgagaaagggaaggtcacagataggttttagagatgactttattgcatgcagcccacagggcactgctaattctgaaactgtgaggagcatgatattttattcaacttataagttagtgtgttagtctttcacatttttatgtgtatctatatgtctatgtctttgtctatgtctgtatctatgataaaagatgcaccaaacccctggatcacagcagcccattaattatttacagcagtaacagcaggtggagtaggatggtagtgctggctccccattcctagggcaacacaatgtttttacctgtaaatgcacaagaatttgcaccaaggagaggggcccccacattatgagtattatagcttatataggacagctagctcatatgctccttctttattacagggtgaaagttagagacagagaaagagagagagagagaatgctttgttctggcgtataaactacccctctcctgtgagatggcaatttctagagttttataacccaaatatcttctggaaagataagattctctgggtttaccactctagaatgtcagcaaatatttttggagcaatacataatttctaacctccaaggcaaattgccattcaaatatcctgtaccccaggttgccagtatctttttctctgaaagtctgtattatgcagaaaaatgaaaatattcgagaaccattgattcctgtcaccagggtccaaagaggaggcaaaggatctgggggaagcccttggagttggggctttggtgatggtgaacaagagagatctagacgtgcagagtgcatttgagtttctggaagatcagagcttcagagattatctcaggttagactccggagtctcagagatagtataatttgtgtgtgtgtgtgtgtgtgtgtgtgtgtgtgtgtgtgtgtgtcttgctttctcttcaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtgctgccttccccattcaccaccaccacccccatcctctacttttgtgtgtgtgtgtgtgaattccaaggttcctagtggagggggcagggttttgatgaggaaaatccaacatcacctcaccccaaaacacacacaagtgtctctccaaggctgctggacataggaaatcccactggcaaaccttctttgtctcacctgcaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtca

SEQ ID NO: 124549 - DNA, 630 bp, Homo sapiens
  Payload ID: 4460
  Gene Symbol: CYP4F12
  Gene Name: cytochrome P450, family 4, subfamily F, polypeptide 12
  ENST ID: ENST00000548237
  CDS Start-End: 62-301
aaagacctcccagcagaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttaaggcaccctgttgttcacatggcagagactgggctccgagaaactgagaggaggctgcaatgtctgtggacattgtctctgcaatacttcaaagttcaaccaggtggttatctgcaaatacaactctgagaaatggctcaggacaagtggcagcacctggcctcagagggcagcagtcgtctggacat

SEQ ID NO: 124550 - DNA, 324 bp, Homo sapiens
  Payload ID: 4460
  Gene Symbol: CYP4F12
  Gene Name: cytochrome P450, family 4, subfamily F, polypeptide 12
  ENST ID: ENST00000551607
  CDS Start-End: 114-324
gggacaagctgctcccgacagaaggtaccaggctgggggtggcagggctggaaggtcctggcctgggatgaagaggggactgcctaaggctggggtggctccaagatgctggcatgggaaactgggggtttcctggtaactggactcctagcaaactcccaaggattcagatcactcctacagaggagggcttgaagaactcgacccagatgtcggccacctattcccagggctttacggtatggctgggtcccatcatccccttcatcgttttatgccaccctgacaccatccggtctatcaccaatgcctcagctgccattg

SEQ ID NO: 124551 - DNA, 593 bp, Homo sapiens
  Payload ID: 4460
  Gene Symbol: CYP4F12
  Gene Name: cytochrome P450, family 4, subfamily F, polypeptide 12
  ENST ID: ENST00000547332
  CDS Start-End: 120-434
agcccagcccagcccagccccgcctcctacggccttccctagatcaggggccagggccaaagacctcccagcagaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacat

SEQ ID NO: 124552 - DNA, 2044 bp, Homo sapiens
  Payload ID: 4460
  Gene Symbol: CYP4F12
  Gene Name: cytochrome P450, family 4, subfamily F, polypeptide 12
  ENST ID: ENST00000550308
  CDS Start-End: 381-1955
gctgccaactgtcatgataagtatatgcttttatctgaacacccttgtcttggaagggcagggtggaggtaaacttggggttcagagtcccctctaaccaccctccaacttcccctgcaaactcccaagaaggtactgagacctgagaattcagtgctcgtgctggggcaccctgagctgcacccagtgggcccaaccccaggttttggctggctgcccaggcacggaagacacacccaggctgtggggattggctgcctcagcccagcccagcccagccccgcctcctacggccttccctagatcaggggccagggccaaagacctcccagcagaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacggtatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagtcgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacctctgcctgggcctcactgacagcctgcag

SEQ ID NO: 124553 - DNA, 567 bp, Homo sapiens
  Payload ID: 4460
  Gene Symbol: CYP4F12
  Gene Name: cytochrome P450, family 4, subfamily F, polypeptide 12
  Uniprot ID: Q9HCS2
  ENST ID: ENST00000548435
  CDS Start-End: 51-359
agcagaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacgctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttaaggcaccctgttgttcacatggcagagactgggctccgagaaactgagaggaggctgcaatgtctgt

SEQ ID NO: 124554 - DNA, 2067 bp, Homo sapiens
  Payload ID: 4461
  Gene Symbol: CYP4F2
  Gene Name: cytochrome P450, family 4, subfamily F, polypeptide 2
  ENST ID: ENST00000011989
  CDS Start-End: 34-1596
ggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatgattcacagctcagaagaaggtctcctatacacacaaagcctggcgtgcacctttggggatatgggctgctggtgggtggggccctggcaggcagtcatccacatctttctccccacgtgcatcaagcctgtgctctttgctccagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtggg

SEQ ID NO: 124555 - DNA, 2407 bp, Homo sapiens
  Payload ID: 4461
  Gene Symbol: CYP4F2
  Gene Name: cytochrome P450, family 4, subfamily F, polypeptide 2
  Uniprot ID: P78329
  ENST ID: ENST00000221700
  CDS Start-End: 97-1659
ctcccacagcctttgctatatcaagggccagggtcaaaggcctcccagcagacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggatgaagacgggaagaagttatctgatgaggacataagagcagaagctgacacctttatgtttgagggccatgacaccacggccagtggtctctcctgggtcctgtaccaccttgcaaagcacccagaataccaggagcgctgccggcaggaggtgcaagaacttctgaaggaccgtgagcctaaagagattgaatgggacgacctggcccatttgcccttcctgaccatgtgcatgaaggagagcctgcggctgcatcccccagtcccggtcatctcccgccatgtcacccaggacattgtgctcccagacggccgggtcatccccaaaggcattatctgcctcatcagtgttttcggaacccatcacaacccagctgtgtggccggaccctgaggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaaagacgcttgtgcgtgaatgttcatggcggccctattcacagtagccaaacgatgaaaacaaccccaagctatatattaccagatgaaaggataaacaaaatgtggtccatccatacaatggagtattacacagccataaaaaggaatgaagcagtgatccctactacactgtggatgaaccttgaatgcatgatactgaatgaaagacgtcagatgcaaaaggtcacatagtgtactgtccttttatacgaaatttccagaacaggccaatctgaagagatgcatagcggattggtggctttcagcagctgtggggaggtgggactgaggagcgactgctaatcagtatggggtttcctcccgggatggtgaaaatgttccggacctagatagtgacgaaggtagcacgacactgtgagtgcactaaatgctattgaattggacactttgaaatggtgaatttcgtggtatgtgaattctacctcaatcaaaaaaatttgctattttatctcacatacattttttttctgtccaggttgttcatataataatatgctgtgagcatctttccatgacattaaatcatcttaggaaacatta

SEQ ID NO: 124556 - DNA, 579 bp, Homo sapiens
  Payload ID: 4461
  Gene Symbol: CYP4F2
  Gene Name: cytochrome P450, family 4, subfamily F, polypeptide 2
  ENST ID: ENST00000586927
  CDS Start-End: 119-579
gagccctccctgctctacctccggcactgcccgtccctgcctctccactgtccctggaggtccctgggccgttctctgggcctcaggatctcaccgtccatcccgtctgccctgcaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatggtcaaccccacagaggagggcatgagagttctgactcagctggtggccacctacccccagggctttaaggtctggatgggacccatctcccccctcctcagtttgtgccaccccgacatcatccggtctgtcatcaacgcctcagctgccattgcaccaaaggacaagttcttctacagcttcctggagccctggctgggggatgggctcctgctgagtgctggtgacaagtggagccgccaccgtcggatgctgacgcctgc

SEQ ID NO: 124557 - DNA, 954 bp, Homo sapiens
  Payload ID: 4461
  Gene Symbol: CYP4F2
  Gene Name: cytochrome P450, family 4, subfamily F, polypeptide 2
  ENST ID: ENST00000587671
  CDS Start-End: 48-317
agacagagagaggaggttgtctgggacagactgctcctgacagaaggatgtcccagctgagcctgtcctggctgggcctctggccagtggcagcatccccttggctgctcctcctgctggtcggggcctcctggctcctggcccatgtcctggcctggacctacgccttctatgacaactgccgccgccttcggtgtttcccacaacccccaagacggaactggttttggggacaccagggcatgctgccattgcaccaaaggacaagttcttctacagcttcctggagccctggctgggggatgggctcctgctgagtgctggtgacaagtggagccgccaccgtcggatgctgacgcctgccttccatttcaacatcctgaagccctatatgaagattttcaatgagagtgtgaacatcatgcacgccaagtggcagctcctggcctcagagggtagtgcctgtttggatatgtttgagcacatcagcctcatgaccttggacagtctacagaaatgtgtcttcagctttgacagccattgtcaggagaaacccagtgaatatattgccgccatcttggagctcagtgcccttgtatcaaaaagacaccatgagatcctcctgcatattgacttcctgtattatctcacccctgatgggcagcgtttccgcagggcctgccgcctggtgcacgacttcacagatgccgtcatccaggagcggcgccgcactctccctagccagggtgttgatgacttcctccaagccaaggccaaatccaagactttggacttcattgatgtactcctgctgagcaaggccatgacaccacggccagtggtctctcctgggtcctgtaccaccttgcaaagcacccagaataccaggagcgctgccggcaggaggtgcaagaacttctgaaggaccgtgagcctaaagagattgaatgggac

SEQ ID NO: 124558 - DNA, 499 bp, Homo sapiens
  Payload ID: 4461
  Gene Symbol: CYP4F2
  Gene Name: cytochrome P450, family 4, subfamily F, polypeptide 2
  ENST ID: ENST00000589654
  CDS Start-End: 1-223
ctgggtcctgtaccaccttgcaaagcacccagaataccaggagcgctgccggcaggaggtgcaagaacttctgaaggaccgtgagcctaaagagattgaatggtctacgacccctttcgctttgacccagagaacatcaaggagaggtcacctctggcttttattcccttctcggcagggcccaggaactgcatcgggcagacgttcgcgatggcggagatgaaggtggtcctggcgctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaagcctagaattaccctaagaccctgttccacagtcctgtattccatcctagatatctactcaaaataattgagacaagtgttcaaacagaa

SEQ ID NO: 124559 - DNA, 2641 bp, Homo sapiens
  Payload ID: 4462
  Gene Symbol: CYP4F22
  Gene Name: cytochrome P450, family 4, subfamily F, polypeptide 22
  Uniprot ID: Q6NT55
  ENST ID: ENST00000269703
  CDS Start-End: 200-1795
gttaaagggttgggccgtgggacggcgcggtcagatcccaggtagtggcgccggtggatccggatcgagggcaggaggctgagacccgcgggagctggccctaaagcaaggacctgagtgcaagtaatttttttgggaagtaataacagaaaataccagcaaggaagaagacagtgaacccaaaagaattgaaaacaggatgctgcccatcacagaccgcctgctgcacctcctggggctggagaagacggcgttccgcatatacgcggtgtccacccttctcctcttcctgctcttcttcctgttccgcctgctgctgcggttcctgaggctctgcaggagcttctacatcacctgccgccggctgcgctgcttcccccagcctccccggcgcaactggctgctgggccacctgggcatgtaccttccaaatgaggcgggccttcaagatgagaagaaggtactggacaacatgcaccatgtactcttggtatggatgggacctgtcctgccgctgttggttctggtgcaccctgattacatcaaaccccttttgggagcctcagctgccatcgcccccaaggatgacctcttctatggcttcctaaaaccttggctaggggatgggctgctgctcagcaaaggtgacaagtggagccggcaccgtcgcctgctgacacccgccttccactttgacatcctgaagccttacatgaagatcttcaaccagagcgctgacattatgcatgctaaatggcggcatctggcagagggctcagcggtctcccttgatatgtttgagcatatcagcctcatgaccctggacagtcttcagaaatgtgtcttcagctacaacagcaactgccaagagaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcagggggccgaggcctggcttaaggccaagcaggggaagaccttggactttattgatgtgctgctcctggccagggatgaagatggaaaggaactgtcagacgaggatatccgagccgaagcagacaccttcatgtttgagggtcacgacacaacatccagtgggatctcttggatgctgttcaatttggcaaagtatccggaataccaggagaaatgccgagaagagattcaggaagtcatgaaaggccgggagctggaggagctggagtgggacgatctgactcagctgccctttacaactatgtgcattaaggagagcctgcgccagtacccacctgtcactcttgtctctcgccaatgcacggaggacatcaagctcccagatgggcgcatcatccccaaaggaatcatctgcttggtcagcatctatggaacccaccacaaccccacagtgtggcctgactccaaggtgtacaacccctaccgctttgacccggacaacccacagcagcgctctccactggcctatgtgcccttctctgcaggacccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctcctccccttagggggcctgatcccgccccttgaggcttaggtcccgccccctgacttctcgcacctgtcctgtttgagggaccagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctgaacccctggcaggcttccaaactgaggaaagctggagcctgacgtcagagcttttaactcggacatcaccctcctgaggccctcagctcatacgggcagactgctcaggcgtgaggctggatcgtagggttcgaggctgcttgcttttgttgttgttttgtaaactcagacccttgtaagccccttccttcctcccttgcccaaagatcctttgctgagtgttctgtttttgcagaataaaagcaaaggatgcagacttaccccaccctccacccctagctcagccagatccttacacgtggagcccccagcatgggaatgaggggctctgcaactgagcgaagctgcgggctaggaggctggaaagccatttatcctaggacataaactcagattttgggggtca

SEQ ID NO: 124560 - DNA, 2445 bp, Homo sapiens
  Payload ID: 4462
  Gene Symbol: CYP4F22
  Gene Name: cytochrome P450, family 4, subfamily F, polypeptide 22
  Uniprot ID: Q6NT55
  ENST ID: ENST00000601005
  CDS Start-End: 5-1600
caggatgctgcccatcacagaccgcctgctgcacctcctggggctggagaagacggcgttccgcatatacgcggtgtccacccttctcctcttcctgctcttcttcctgttccgcctgctgctgcggttcctgaggctctgcaggagcttctacatcacctgccgccggctgcgctgcttcccccagcctccccggcgcaactggctgctgggccacctgggcatgtaccttccaaatgaggcgggccttcaagatgagaagaaggtactggacaacatgcaccatgtactcttggtatggatgggacctgtcctgccgctgttggttctggtgcaccctgattacatcaaaccccttttgggagcctcagctgccatcgcccccaaggatgacctcttctatggcttcctaaaaccttggctaggggatgggctgctgctcagcaaaggtgacaagtggagccggcaccgtcgcctgctgacacccgccttccactttgacatcctgaagccttacatgaagatcttcaaccagagcgctgacattatgcatgctaaatggcggcatctggcagagggctcagcggtctcccttgatatgtttgagcatatcagcctcatgaccctggacagtcttcagaaatgtgtcttcagctacaacagcaactgccaagagaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcagggggccgaggcctggcttaaggccaagcaggggaagaccttggactttattgatgtgctgctcctggccagggatgaagatggaaaggaactgtcagacgaggatatccgagccgaagcagacaccttcatgtttgagggtcacgacacaacatccagtgggatctcttggatgctgttcaatttggcaaagtatccggaataccaggagaaatgccgagaagagattcaggaagtcatgaaaggccgggagctggaggagctggagtgggacgatctgactcagctgccctttacaactatgtgcattaaggagagcctgcgccagtacccacctgtcactcttgtctctcgccaatgcacggaggacatcaagctcccagatgggcgcatcatccccaaaggaatcatctgcttggtcagcatctatggaacccaccacaaccccacagtgtggcctgactccaaggtgtacaacccctaccgctttgacccggacaacccacagcagcgctctccactggcctatgtgcccttctctgcaggacccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctcctccccttagggggcctgatcccgccccttgaggcttaggtcccgccccctgacttctcgcacctgtcctgtttgagggaccagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctgaacccctggcaggcttccaaactgaggaaagctggagcctgacgtcagagcttttaactcggacatcaccctcctgaggccctcagctcatacgggcagactgctcaggcgtgaggctggatcgtagggttcgaggctgcttgcttttgttgttgttttgtaaactcagacccttgtaagccccttccttcctcccttgcccaaagatcctttgctgagtgttctgtttttgcagaataaaagcaaaggatgcagacttaccccaccctccacccctagctcagccagatccttacacgtggagcccccagcatgggaatgaggggctctgcaactgagcgaagctgcgggctaggaggctggaaagccatttatcctaggacataaactcagattttgggggtc

SEQ ID NO: 124561 - DNA, 5050 bp, Homo sapiens
  Payload ID: 4463
  Gene Symbol: CYP4F3
  Gene Name: cytochrome P450, family 4, subfamily F, polypeptide 3
  Uniprot ID: Q08477
  ENST ID: ENST00000221307
  CDS Start-End: 48-1610
agaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcagtggcatgatctcagttcactgcaacctccgcctcctgcgttcaagtgattgtcctgtctcagcctcccaagtagctgggattacaggcacccaccaccacatccagctaattgttgtatttttaatagaggcggggtttcgccatgttgcactggctggtgttgaactcctaacctcaggtgatccacccgcctcggcctcccaaagtgctgggattacaggcccggtccagtttgatagtttgttatcatgttatacgtacacttagaataatgatccagccatctcattctaacagcaatgagaacttaggctcccctctctactaaaatacaaaagttagctggtcatggtggtgcgggcctgtaatcccagctactcgggaggctgatgcgggagaatcacttgaaacccacaggcggaggttgcagtgagctgaggtggtgccactacgctccagcctgggggagggggacatagcgagactcggtctcaaaaacaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacattttttccccaataatttttggctattctgcttcctttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaaga

SEQ ID NO: 124562 - DNA, 559 bp, Homo sapiens
  Payload ID: 4463
  Gene Symbol: CYP4F3
  Gene Name: cytochrome P450, family 4, subfamily F, polypeptide 3
  ENST ID: ENST00000587360
  CDS Start-End: 123-362
gtttactcttactgttctatctccagcactgcccgtctctgcctctctccactgtccctggagctccctgggcccttccctgggcctcaggacctcactcaccaccccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcac

SEQ ID NO: 124563 - DNA, 2338 bp, Homo sapiens
  Payload ID: 4463
  Gene Symbol: CYP4F3
  Gene Name: cytochrome P450, family 4, subfamily F, polypeptide 3
  Uniprot ID: Q08477
  ENST ID: ENST00000586182
  CDS Start-End: 35-1597
agaagaaggggagaggaggttgtgtgggacaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacatta

SEQ ID NO: 124564 - DNA, 2983 bp, Homo sapiens
  Payload ID: 4463
  Gene Symbol: CYP4F3
  Gene Name: cytochrome P450, family 4, subfamily F, polypeptide 3
  Uniprot ID: Q08477
  ENST ID: ENST00000591058
  CDS Start-End: 48-1610
agaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcc

SEQ ID NO: 124565 - DNA, 2056 bp, Homo sapiens
  Payload ID: 4463
  Gene Symbol: CYP4F3
  Gene Name: cytochrome P450, family 4, subfamily F, polypeptide 3
  Uniprot ID: Q08477
  ENST ID: ENST00000585846
  CDS Start-End: 108-1670
tctatctccagcactgcccgtctctgcctctctccactgtccctggagctccctgggcccttccctgggcctcaggacctcactcaccaccccatctgccctgcaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactg

SEQ ID NO: 124566 - DNA, 561 bp, Homo sapiens
  Payload ID: 4463
  Gene Symbol: CYP4F3
  Gene Name: cytochrome P450, family 4, subfamily F, polypeptide 3
  ENST ID: ENST00000592424
  CDS Start-End: 1-225
atcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggtgggcctctctgggatctgaattcaagaagtagaagggagcttcatgtgaaatgtcagatgaaagaatttgaacttgacccagagggcactggggagccatggaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctga

SEQ ID NO: 124567 - DNA, 1569 bp, Homo sapiens
  Payload ID: 4463
  Gene Symbol: CYP4F3
  Gene Name: cytochrome P450, family 4, subfamily F, polypeptide 3
  ENST ID: ENST00000620621
  CDS Start-End: 1-1569
atgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagcgttctgcag

SEQ ID NO: 124568 - DNA, 1889 bp, Homo sapiens
  Payload ID: 4464
  Gene Symbol: CYP4F8
  Gene Name: cytochrome P450, family 4, subfamily F, polypeptide 8
  Uniprot ID: P98187
  ENST ID: ENST00000612078
  CDS Start-End: 62-1624
aaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgctgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgacccagaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagac

SEQ ID NO: 124569 - DNA, 778 bp, Homo sapiens
  Payload ID: 4464
  Gene Symbol: CYP4F8
  Gene Name: cytochrome P450, family 4, subfamily F, polypeptide 8
  ENST ID: ENST00000617645
  CDS Start-End: 145-778
agcaaaaacctcctggcaaaggaggagaggaggttgtgcgggacaaccttctcctgacagaaggtgccaggctgggggtggcagggctggatagggaggggcactgcccaagactgggatggctccagggagctggccctggtgatgggtgcttgcaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgctgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgca

SEQ ID NO: 124570 - DNA, 1292 bp, Homo sapiens
  Payload ID: 4464
  Gene Symbol: CYP4F8
  Gene Name: cytochrome P450, family 4, subfamily F, polypeptide 8
  ENST ID: ENST00000325723
  CDS Start-End: 65-274
agcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgacccagaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatgg

SEQ ID NO: 124571 - DNA, 588 bp, Homo sapiens
  Payload ID: 4464
  Gene Symbol: CYP4F8
  Gene Name: cytochrome P450, family 4, subfamily F, polypeptide 8
  ENST ID: ENST00000589722
  CDS Start-End: 1-311
gcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgacccagaaaacgcccagaagaggtcacctatggcttttattcctttctcggcggggcccagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttccccccc

SEQ ID NO: 124572 - DNA, 2042 bp, Homo sapiens
  Payload ID: 4465
  Gene Symbol: CYP4V2
  Gene Name: cytochrome P450, family 4, subfamily V, polypeptide 2
  Uniprot ID: Q6ZWL3
  ENST ID: ENST00000378802
  CDS Start-End: 305-1882
gggcctccagtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgtcgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccctttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgagaattttttcagcagatcattgagtacacagaggaataccgccacatgccgctgctgaagctctgggtcgggccagtgcccatggtggccctttataatgcagaaaatgtggaggtaattttaactagttcaaagcaaattgacaaatcctctatgtacaagtttttagaaccatggcttggcctaggacttcttacaagtactggaaacaaatggcgctccaggagaaagatgttaacacccactttccattttaccattctggaagatttcttagatatcatgaatgaacaagcaaatatattggttaagaaacttgaaaaacacattaaccaagaagcatttaactgctttttttacatcactctttgtgccttagatatcatctgtgaaacagctatggggaagaatattggtgctcaaagtaatgatgattccgagtatgtccgtgcagtttatagaatgagtgagatgatatttcgaagaataaagatgccctggctttggcttgatctctggtaccttatgtttaaagaaggatgggaacacaaaaagagccttcagatcctacatacttttaccaacagtgtcatcgctgaacgggccaatgaaatgaacgccaatgaagactgtagaggtgatggcaggggctctgccccctccaaaaataaacgcagggcctttcttgacttgcttttaagtgtgactgatgacgaagggaacaggctaagtcatgaagatattcgagaagaagttgacaccttcatgtttgaggggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtataggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaa

SEQ ID NO: 124573 - DNA, 2357 bp, Homo sapiens
  Payload ID: 4466
  Gene Symbol: CYP4X1
  Gene Name: cytochrome P450, family 4, subfamily X, polypeptide 1
  Uniprot ID: Q8N118
  ENST ID: ENST00000371901
  CDS Start-End: 251-1780
caaaagcagttgggccgaacgaagcgtgcgcgctttggtaaccggctagaaatcccgcacgcgcgcctgcctcctctccccaggcctgagctgcccctcccactgcctttccttcttcccgcgagtcagaagcttcgcgagggcccagagaggcggtggggtgggcgaccctacgccagctccgggcgggagaaagcccaccctctcccgcgccccaggaaaccgccggcgttcggcgctgcgcagagccatggaattctcctggctggagacgcgctgggcgcggcccttttacctggcgttcgtgttctgcctggccctggggctgctgcaggccattaagctgtacctgcggaggcagcggctgctgcgggacctgcgccccttcccagcgccccccacccactggttccttgggcaccagaagtttattcaggatgataacatggagaagcttgaggaaattattgaaaaataccctcgtgccttccctttctggattgggccctttcaggcatttttctgtatctatgacccagactatgcaaagacacttctgagcagaacagatcccaagtcccagtacctgcagaaattctcacctccacttcttggaaaaggactagcggctctagacggacccaagtggttccagcatcgtcgcctactaactcctggattccattttaacatcctgaaagcatacattgaggtgatggctcattctgtgaaaatgatgctggataagtgggagaagatttgcagcactcaggacacaagcgtggaggtctatgagcacatcaactcgatgtctctggatataatcatgaaatgcgctttcagcaaggagaccaactgccagacaaacagcacccatgatccttatgcaaaagccatatttgaactcagcaaaatcatatttcaccgcttgtacagtttgttgtatcacagtgacataattttcaaactcagccctcagggctaccgcttccagaagttaagccgagtgttgaatcagtacacagatacaataatccaggaaagaaagaaatccctccaggctggggtaaagcaggataacactccgaagaggaagtaccaggattttctggatattgtcctttctgccaaggatgaaagtggtagcagcttctcagatattgatgtacactctgaagtgagcacattcctgttggcaggacatgacaccttggcagcaagcatctcctggatcctttactgcctggctctgaaccctgagcatcaagagagatgccgggaggaggtcaggggcatcctgggggatgggtcttctatcacttgggaccagctgggtgagatgtcgtacaccacaatgtgcatcaaggagacgtgccgattgattcctgcagtcccgtccatttccagagatctcagcaagccacttaccttcccagatggatgcacattgcctgcagggatcaccgtggttcttagtatttggggtcttcaccacaaccctgctgtctggaaaaacccaaaggtctttgaccccttgaggttctctcaggagaattctgatcagagacacccctatgcctacttaccattctcagctggatcaaggaactgcattgggcaggagtttgccatgattgagttaaaggtaaccattgccttgattctgctccacttcagagtgactccagaccccaccaggcctcttactttccccaaccattttatcctcaagcccaagaatgggatgtatttgcacctgaagaaactctctgaatgttagatctcagggtacaatgattaaacgtactttgtttttcgaagttaaatttacagctaatgatccaagcagatagaaagggatcaatgtatggtgggaggattggaggttggtgggataggggtctctgtgaagagatccaaaatcatttctaggtacacagtgtgtcagctagatctgtttctatataactttgggagattttcagatcttttctgttaaactttcactactattaatgctgtatacaccaatagactttcatatattttctgttgtttttaaaatagttttcagaattatgcaagtaataagtgcatgtatgctcactgtcaaaaattcccaacactagaaaatcatgtagaataaaaattttaaatctcacttcacttagccgacattccatgccctgaccaatcctactgcttttcctaaaaacagaataatttggtgtgcattctttcagactttttcctatacattttatatgtagaaatgtagcaatgtatttgtatagatgtgatcattcctatattgttattgatttttttcacttaataaaaattcaccttattcctta

SEQ ID NO: 124574 - DNA, 1906 bp, Homo sapiens
  Payload ID: 4467
  Gene Symbol: CYP4Z1
  Gene Name: cytochrome P450, family 4, subfamily Z, polypeptide 1
  Uniprot ID: Q86W10
  ENST ID: ENST00000334194
  CDS Start-End: 4-1521
agaatggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggaataactgtgtttatcaatatttgggctcttcaccacaacccctatttctgggaagaccctcaggtctttaaccccttgagattctccagggaaaattctgaaaaaatacatccctatgccttcataccattctcagctggattaaggaactgcattgggcagcattttgccataattgagtgtaaagtggcagtggcattaactctgctccgcttcaagctggctccagaccactcaaggcctccccagcctgttcgtcaagttgtcctcaagtccaagaatggaatccatgtgtttgcaaaaaaagtttgctaattttaagtcctttcgtataagaattaatgagacaattttcctaccaaaggaagaacaaaaggataaatataatacaaaatatatgtatatggttgtttgacaaattatataacttaggatacttctgactggttttgacatccattaacagtaattttaatttctttgctgtatctggtgaaacccacaaaaacacctgaaaaaactcaagctgacttccactgcgaagggaaattattggtttgtgtaactagtggtagagtggctttcaagcatagtttgatcaaaactccactcagtatctgcattacttttatctctgcaaatatctgcatgatagctttattctcagttatctttccccataataaaaaatatctgccac

SEQ ID NO: 124575 - DNA, 2181 bp, Homo sapiens
  Payload ID: 4468
  Gene Symbol: CYP46A1
  Gene Name: cytochrome P450, family 46, subfamily A, polypeptide 1
  Uniprot ID: Q9Y6A2
  ENST ID: ENST00000261835
  CDS Start-End: 105-1607
ggggccgaggcggcgcgcggcgctgacagctgagtcggctcgcggcctcccggccccctcggcgcccggcccgaccctggcctggcctgccctgccccggagccatgagccccgggctgctgctgctcggcagcgccgtcctgctcgccttcggcctctgctgcaccttcgtgcaccgcgctcgcagccgctacgagcacatccccgggccgccgcggcccagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgca

SEQ ID NO: 124576 - DNA, 1597 bp, Homo sapiens
  Payload ID: 4468
  Gene Symbol: CYP46A1
  Gene Name: cytochrome P450, family 46, subfamily A, polypeptide 1
  Uniprot ID: Q9Y6A2
  ENST ID: ENST00000380228
  CDS Start-End: 251-1462
cacagccgcagcagctgctgggcgcccaccgcgcacagctgggccccacaaacgtgatggcagccacagccctttcagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctg

SEQ ID NO: 124577 - DNA, 6609 bp, Homo sapiens
  Payload ID: 4468
  Gene Symbol: CYP46A1
  Gene Name: cytochrome P450, family 46, subfamily A, polypeptide 1
  ENST ID: ENST00000554611
  CDS Start-End: 115-405
cgcctggcctggggccgaggcggcgcgcggcgctgacagctgagtcggctcgcggcctcccggccccctcggcgcccggcccgaccctggcctggcctgccctgccccggagccatgagccccgggctgctgctgctcggcagcgccgtcctgctcgccttcggcctctgctgcaccttcgtgcaccgcgctcgcagccgctacgagcacatccccgggccgccgcggcccagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagttccattagtttggcttcctgcattttgaagttctgttatcagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaaggtactgcctcagcaccccctctggtgaccagccaccagagctgttgtcttcatttgctgaagaacctccttcagtgattttttttttttttcccagaatgggttttgagttctggtatgtctgaagtgacttctgaatcaggatttgcatgcattgcctaaagtaaaggcttaaaatcaaattgccttaaagtaaattaggagttaatctttctctcatgtgaaatgatccccaaagcaggcaatgtaggatgactatgatggctccatggtgtcagattttctggatccttctgtcttcctgttccactgtctcagcacatcacctcattgtcataagatggctgctgcgaaaggtgcaccctgcctgccactgcccgtgcccacatggggcctgggaaccaatctgccccacccgctgcagctaccaccacctgcacgcactgtccagggaccagacatgccccacccactgccagcacccgtgcgcatcatctaggggcctgaggaatggtctaccatgagtgctgccaccagcgcctgccactgagagggcctgaggagaggcctgccccacttgccgacactggcccccacatgcatcatccacgggcctgaggaatggtctaccatgactgctgccaccagcgcctgccactgagagggcctgaggagaggcctgccccacttgccgacactggcccccacatgcatcagccaggggcctgaggaatggtctaccatgagtgctgccaccagcgcctgccactgagagggcctgaggagaggcctgccccgcttgccgacactggcccccacatgcatcatccaggggcctgaggaatggtctaccatgactgctgccactagcgcctgccattgagagggcctgaggagaggcctgccccacttgccgacactggcccccacatgcatcatccacgggcctgaggacaagcctgcccagcccaccacccactgttgcctgcacccaagcatgccatctggaggcctggggattggcttgccctgcctaatgtaggtagtgcctgtgtgcaatattggaggacacctgaggataggcccatccctcccgctactgctggcgcccacatatgccatccaagggcctgagcacaggcccatcctacccactgttgccaccagtgatgctcaaggactggcctgcctggcatctccatcctcagcaaagcctcaggatggcctccactaacaatgacagtctaagccactgagaaactcagagataccactgacactgattacagctgaagaaattaaacagaaactatgttactgtgccaatccataatcaagccaaagcaccctacccacccaacactataaatgcccctatagaaaagtctttccctatgaaagccaatccataaaattggaagaagtaactattacactagatgcacaaaggggcaaaagaaacatggaaaaagcaaggaaatactataccttcaaagaaacaataactctccagcaacagattccaaagaaaataaaatttattatatgtctgaaaaagaattcaaaataatgatattaaactctgagatacaagagaacacagataaaaatgcaaagaaatcaggaaaacaattcatcacctgaatgagaaattcaacagagagacagatagatgtaaaagagaaacaaacagaaatcttaaaactgaggaattcagtgaatagaataaaaatataattgaaaacttcaacaatagactagattaagcagaagaaagaatttctgaacttgaagacaggtcttttttgaagcaacccaatcagaccaaaaaaagaaaagattgaagaaagcctttgtgacatgagacagcagtaagtgaccaaatattccagttccgggaatttcaggagaagagatgggcaaaggcatatgaaacctatttaatcaaataatagctgaaaacttctcaagtcttgcaaaagatatagacatccaggtacaggaaatatagagatccaggtatagtcatgctttgtataatgatgggagctcaaaaatctccgagtagattcaacccaaaaaggtctgccttctccaaggcacattatagtcaaagtgttgaaagtcaaagacacagagagaattttaaaaacagcaagagagaagcatgaattcacatataaaggaatcagactaaagtagattgctcagtgaaaatcttacaagccaggagtgattgggataatatattcaaagtgctggaaattaaaaactgtcagtcaagattatagtacccagtaatgctatacttccaaactgaaagagaaataaagtctgtcccaaacaagcaaaaaccgaggtaagtcatcactactagactggccctacaagaaatgtttaagggaattctgcatctggaagtgaaaggacaatctctatcatcatgaaaacacatgaaagtataaagcccactgatagggcagatcagcaaatgagaaagagaaaggagttaaacattactattatagaatgtttaccaaactgcaatgataaacagtaagagaggaagacaggcacaaaatatatacagaaaacaattaatcaaacaaccagaaaacaattaaccaaatgactagagtaagtccttacctatcaataataaccttgaatgtaactagattaaattcccccacttaaaagatatagattgactgaatggataaaaaaattacccaactatatgctgcttacaagaaactcacttcgcctgtaaagacacatacagactgaaagtaaaggaatggaaaaagatattccacacaaacacaagccaaagctgtcaggagtagctataattatatcaaataaaacagactttaagtcaaaaactgtaaaaagagacaaggtcattatataatgataaagggatcaattctgcaagaagataaaatacttctaaatatatttgcacccaataccagagcacccagagatagaaagcaaagatctaaaggaaaagatagactctaatacagtaatagctggggacttcaacaccccactctcagcactggacagatcatctagacagaaaatcatcacagaaacattggatttaactacactttagaccgtatagacctaatagacatttacagaacttttcatctaatagctgcagaacatacattcttctcatcagcacatgaaagattctccaggatagatcatatcttaggccacaaaacaaattttaagaaattgaaatcatatcaagtatcttctcagaccacaatggaataaaactagaaatcaataacaagtgaaactttggaaattgtacaaatacatggaaattaaacaatatactcctgaatgaccactgggtcaatgaagaaattaagaaggaaataaaaaaattcttgaaacaaatgaaaaggggaacacaacataccaaaacctgtgggatacagcaaaagcagtgctaagagcgatgtttataacagtaaacacttacatcaaaaaagtaggaagatttcaaataaacagccaaatgatatatctcaaggaattagaaaagcaagaacaaatcaaagccaaaattagtagaaggaaataaatatcagtgcagaattaaaggaactaaagactaaaaaagtacaaagaccaatgaagtgaaaggttgatttttggaaaagataaaatcaataaaccaagccaagaaaaaaaagaagacccatataaataaaagcagaaactaaaaaggagacattacaactgataccacagaaatacaaaggaacattacagatttttatgaaccactatacactaacgattggaaaacttaaaagaaatggaattcctggacacatacaccctgccaagatgattgaacaaagaagaaatagaaaacctgaacagaccaatggtgagtaatgagattgaaatactaataaaaagtcttccaacaaagaaaagcccgtgaccagatgtctttactgctgaattctcccaaacccatgaagaagaacaccaattcttctcaaactattccaaaaaattgaagaagagggaactcttcctaacttattctatgaggccagcactaccctaccctgataccacaaacagacaaggacacaataaaaaaagaaaaactacatgccaacgtccctgatgaacatagatgcaaaaatattcaacaaaatactagcaaacaaacctaatccaacaacacattaaaaaggtaattcaccatgattaagtgggatttatcccagggatgcaagggtgcttcaacatacacaagtcaataaatgttatacatcatattaacaggatgaaggacaaaagccatatgatcatctcaatagatgcagaaaaagcacttgataaaatttaacaccacttcatgattaaaaactctcaacgaattatgaatagaaggaacgtagctcaacataatgaaggtcgtatatgatatacccacagctaacatcatacttagtggggaaaagctaaaagtctttcctttaagaactggaacaggataaggatgcccactttcatcactcttattcaacgtagtactattaatagaagtgctagccagagcagtcaggcaagagaaagaaataaaagacgtccaaattggaaaagaagaagtcaaactgtccctctttgcagaagacatgatcttatatttagaaattcctaaagactctaccaaaaaactcttagaactgatgaatgacttcagtaaagttgtggggtaaaaaaaaatcagcatacaaaaatcagtagcaattctatacaccaataatgaactcatggaagaagaaaccaataaagcaatcccatttacaattgttatgtagaaaataaaatacctaggaataaatttaaccaaggaggtgaaagacctatacaaggaaaactacaaaacactgatgaaagaaattgaagaagacacaaacaaatgaaaaaacatcccatgctcatggatcgaaagaattaatattgttaaaatgaccatgctacctaaagcaatctaaagattcaatgcaatctctgtcaaaataccaatgacattcttcacagaaatagaaaaagcaatcttaaaatttgcgtgaaaccacgaaagagccaaatagccaaagcaactctgagcaaaaagaacaaagctggaggcaccatactacccgatttcaaaatctactataaagctacaataaccaaaacagcatggtattggtttaaaaaataacaacagacatagaccaatgtaacagaatagacagcccagaaatatattcatgtatttacaggaaacagactcaacaaaggcaccaagaacatacactggggaaagggcagtgctgggaaaactggatatctaaatgcagaagaattaaaccatacccctgtctctcaccatatacaaaaatcaccttaaaatgaatagacttggccgggcgcagtagctcacgcctgtaataccagcactttgggaggccaagatgggcggatcacgaggtcaggagatggagaccatcctggctaatatggtgaaaccctgtctctactaaaaatacaaaaaattagctgggtgtggtggcacacacctatagtcccagctacttgggaggctgaggcaggagaatcacttgaacccgggaggcagaggttgcagtgagctgagatcatgccactgcactccagcctgggcgacagagcgagactacaagactacatctc

SEQ ID NO: 124578 - DNA, 682 bp, Homo sapiens
  Payload ID: 4468
  Gene Symbol: CYP46A1
  Gene Name: cytochrome P450, family 46, subfamily A, polypeptide 1
  ENST ID: ENST00000556313
  CDS Start-End: 1-495
cgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttggaacagtgtgcaagccagctcctcggacatttacccagaagtgagagggctgggttgtaggacccctgactgttcagctttacaaacgaacgccacattgttttccaaagtggctgcaccaacttggatgcccagtagtggtgagagagagcacctgctgttcttcatcatctccagcacttagcatggtccgattttgtatctgctgccatccaaatatgtgtttttaaaaaagtatttcactgtg

SEQ ID NO: 124579 - DNA, 622 bp, Homo sapiens
  Payload ID: 4468
  Gene Symbol: CYP46A1
  Gene Name: cytochrome P450, family 46, subfamily A, polypeptide 1
  ENST ID: ENST00000554917
  CDS Start-End: 1-155
ttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatgggttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcaggtaggaggggcag

SEQ ID NO: 124580 - DNA, 3210 bp, Homo sapiens
  Payload ID: 4469
  Gene Symbol: CYP51A1
  Gene Name: cytochrome P450, family 51, subfamily A, polypeptide 1
  ENST ID: ENST00000003100
  CDS Start-End: 167-1696
ttctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaata

SEQ ID NO: 124581 - DNA, 747 bp, Homo sapiens
  Payload ID: 4469
  Gene Symbol: CYP51A1
  Gene Name: cytochrome P450, family 51, subfamily A, polypeptide 1
  ENST ID: ENST00000422867
  CDS Start-End: 1-667
cagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaaca

SEQ ID NO: 124582 - DNA, 1729 bp, Homo sapiens
  Payload ID: 4469
  Gene Symbol: CYP51A1
  Gene Name: cytochrome P450, family 51, subfamily A, polypeptide 1
  Uniprot ID: Q16850
  ENST ID: ENST00000450723
  CDS Start-End: 262-1476
acagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcagaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgag

SEQ ID NO: 124583 - DNA, 556 bp, Homo sapiens
  Payload ID: 4469
  Gene Symbol: CYP51A1
  Gene Name: cytochrome P450, family 51, subfamily A, polypeptide 1
  ENST ID: ENST00000435873
  CDS Start-End: 467-556
aacctgttccggtccccttccacactgcggaagcattgttctttcgctctttgcaataaatcttgctgctgctctctctttgggtccacactgcctttatgagctgtaacactcaacacgcaggtctgcagcttcactcttgaagccagcaagaccaggaacccaccgggagaaaggaacaactccagacgcgccgccttaagagctgtaacactcactgcgaaggtctgcagcttcactcctgagccagcgagaccacgatcccaccagaaggaagaaactccgaacacatccgaacatcagaaggaacaaactccagaggcgccatcttaagagctgtaacactgaccgtgagggtcggcttcatacttgaagtcagtgagacgaagaacccaccaattccggacacaatttgacttaagccaggccattaacagtttcttttggatctttttgcagagctactatggaagatgcactctttctgcggaaaagtcctccatacattttctccccaattccattccttgggcatgccatagcatttgggaaaagt

SEQ ID NO: 124584 - DNA, 2950 bp, Homo sapiens
  Payload ID: 4470
  Gene Symbol: CYP7A1
  Gene Name: cytochrome P450, family 7, subfamily A, polypeptide 1
  Uniprot ID: P22680
  ENST ID: ENST00000301645
  CDS Start-End: 139-1653
gctttgtcaaccaagctcaagttaatggatctggatactatgtatataaaaagcctagcttgagtctcttttcagtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgtgatatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgctgtgtacaacaatgctttgataaaatattttaagtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatcta

SEQ ID NO: 124585 - DNA, 2202 bp, Homo sapiens
  Payload ID: 4471
  Gene Symbol: CYP7B1
  Gene Name: cytochrome P450, family 7, subfamily B, polypeptide 1
  Uniprot ID: O75881
  ENST ID: ENST00000310193
  CDS Start-End: 175-1695
tcattcagcctgggagaccacggtgacattcctgtctgcgctgcgggcaggccagcctctccggccctggactagggggcgccgccgagagaagccgccgcaggctgcagagtcgccgaccgcgctgttcgcaggcagaccccgggctgcccaccgcggcctagcgcgcgccggatggcaggagaagtgtccgcggccacgggccgcttttcgctggagcggttgggcctcccgggcctggccctcgccgcggccctgctgctcctggccctctgcttgcttgtccggcgcaccaggagacccggtgagcctccattgataaaaggttggcttccttatcttggagtggtcctgaacttacgaaaagaccccttaaggttcatgaaaacacttcaaaagcaacatggtgacactttcacagttcttcttggtggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaatttgatgacaagtttgcatatttagtatccaacatacccattgagcttctaggaaatgtcaagtctattagagagaaaattataaaatgcttctcatcagaaaagttagccaagatgcaaggatggtcagaagtttttcaaagcaggcaagatgtcctggagaaatattatgtgcacgaggaccttgaaataggagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagaggagtttagatatgatcgttttatagaagatggtaagaagaaaaccacctttttcaaaagagggaaaaagctgaagtgttacctaatgccgtttggaactggaaccagcaaatgtccaggccgattttttgcacttatggaaataaaacaattgttggttatacttttaacttattttgatttagaaataattgatgataagcccataggactaaactacagccgcttgttgtttggtattcagtatccagattctgatgttttatttagatacaaagtgaaatcttagagaagctaaaaggaaagaaaataaatctatcaaaattaccctaaacatcctaagctcatctatttctttttaatttctgcaaatgtaattgatttatttgtttaaaaagcgctaatttctatttgatctgatatcagtccagtttgtccttagtcacaaagcccatcataatataaaacaggatggtggcaggaaaatggacatcaaaatcaacttaagggtaggctcaaaacagggttgttgttgtttttttagtttctccttgttgtgattttcacctgttataataaatgtaccttcacaccaatagattgggcactgtggaatttaaatcactcaaattgttctctaatatgtaaaattacactttgaactactagaaaattgtgctggaaatggacacagtctaacaaattccaaattctcacagaagaaggaaattgaatttccatgagttacactggatgaaaatgttcccttcaagtataatattaataatacctatat

SEQ ID NO: 124586 - DNA, 3974 bp, Homo sapiens
  Payload ID: 4472
  Gene Symbol: CYP8B1
  Gene Name: cytochrome P450, family 8, subfamily B, polypeptide 1
  Uniprot ID: Q9UNU6
  ENST ID: ENST00000316161
  CDS Start-End: 350-1855
gtgggctcaaggcaggcttagagagaaggtgcaagagctgtctgaaaaggtcagagcaaagcatgaagctggtgagcagctgtgaccatagctggaagcttctctctgagctttctcctggttacctcctcctcccctacgtgaccagtcagccaagtgttaagtccaggggaacattttgctgcttccaagtactgtctcactagtgttatttgccataacttgcggccacagggcaaggtccaggtgctcagacctttacatcctggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggctccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggtgaagctctttatcctgcttatggtcacacactttgacttagagttggtggaccctgacacaccactaccccatgttgacccgcagcgctggggttttggcaccatgcagcccagccacgatgtgcgcttccgctaccgcctgcatcctacagagtgagcttggccaagccagctgcaaacctggccagaggagttctattgcatctctcacctgttctcacccctctgcagccccaagaccccactggccacccctccctctggtcctgtggcaccccctacctctgttctgcctgtcctcgctctctccccgcctagtcatctgacaggcttatcattctctttaaaataccatctctcagagtgggttctgccgaaccctcctctcacaggaagtccagaggaagggggagtatctgtgggcaacttggtttgggagatgatgcctgccttgagaagtcctgagtacagagactggttccccccagacacgagtaacatggcatcttgcaaacatcagcctccactctcccagcttgctttagttttttcagcaacacttatcccacatcctatggaattcaggttctagaacagtgtcatccaacataaatatgaagcaagctacatgagtagtggggttttttggttttgtttgtttgttttgagacagagtcttgctctgtcgccgaggctgcagtgcagcggtgcgatctctgctcactgcaacctctgcctcctgggtttaagcaattctcctgcctcagcctccccagtagctgggattacaggcacctaccaccttgcccagctaatttagtttcctggtaaacacatttttaaaaagtaaaatgaaacaattcatttttataatatactttacttaatccaatatatccaaaatattggcatttcaacgtgatcactattaaaaattttaacgtaatagtttttaccttccctttttcatcctgtcttcaaagtctggtatgtactgtacttttgcagttcttcccagttcagactagccacattccaagtgcttaattgccgtgtgtggcaggtggctgccctattggatagcacaggtctagagaaatgatacctttttttttttttgagacagagtctcactctgttgcccaggctgcagtgcagtggtgtgatcttggctcactacaacctctgcctcccgggttcaagtaattctcctgcctcaggcttctgagtagctgggattataggtgcgcaccaccacacccggctagtttctgtatttttagtagagacggcgtttcaccattttggccggcctcctcggcctcccaaagttctgggattacaggcatgagccactgtgcccagtcaggatgtctttaatgtaggaatcattcaagatccctcctcagtgcccatgtctcccccacctcagggtgctgtcaaccctcccttggtttccatgatcattgctgaactcagagctttcttctatccccagacccacatgggagtctcccagcacctctgactcagcttggccaatgcagaacttggcatctgaacccctgcctcttccctgaaccactcctcctcctgatttccctgctctctctgctcagaacactaccattcaccccatctcccagagacactctccctcctcctctttcaccttcatacaagcaggcccccgtcctatcagtacacccccctgtgatgcctctgaaatatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttagtctccaaacttctcaactttgccagctttctccaatgaaaccatcagtagagacattgctgttcctgcccatcccagtgccagctactccttcctggaagccttcctggatttcacgcatcccatcctctggccagaaatggcctccgaactgtgcagctcctgcagcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctga

SEQ ID NO: 124587 - DNA, 1896 bp, Homo sapiens
  Payload ID: 4472
  Gene Symbol: CYP8B1
  Gene Name: cytochrome P450, family 8, subfamily B, polypeptide 1
  ENST ID: ENST00000437102
  CDS Start-End: 83-1573
ggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggctccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggcagacttcgaaagaaatgttgactcgggtcctcagttgacccaaagtatctatgataccatgatctcatggctgatggaactattcagtgctgctgaaacagaacctctcctgagggagccctggagtcctcccactctgtgagcttctgccccacccttgggctcctatccgatggcatctggaccagatgctgtggaaaccacacatgacctgcccccaccccaggagctcagcctgagtggctttatctaaggcccaactctgttcctgatcaaccttaggaactttacccagtgcctttttctgctggtcttcctgtcctctcctctgcaccaggggcctcctggccttcaactcctcccttttctgggcagcagtaaggacactcctagcacatggctggtgctgggagcctgtgagctgctgcagaaggaggatgtgaggagtatactcgggtcttatca

SEQ ID NO: 124588 - DNA, 2158 bp, Homo sapiens
  Payload ID: 4473
  Gene Symbol: CYGB
  Gene Name: cytoglobin
  Uniprot ID: Q8WWM9
  ENST ID: ENST00000293230
  CDS Start-End: 364-936
ggtgggcgggcggcagtcgcgtcgcccccaccccgcgcagccttcaccttgccggcattggctcttacccacacggggctgggggtttggagcggatttgtttttttaaacattttccagcagaccacatccccgccccaccgctggctgtcccccgccccccgcacatataccctgcacacacgcacgcacacacacacacacacccggcgcgcacagacacacgctccctccctccgcgctctacccctcgcccgcccgccgcgcacgcagccggccccggctcccggcgccccgcgccccgcgccccgcgccccgccaccgccgccgccgagcaaagccgggctgggcttggagctgctcatggagaaagtgccaggcgagatggagatcgagcgcagggagcggagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctgta

SEQ ID NO: 124589 - DNA, 830 bp, Homo sapiens
  Payload ID: 4473
  Gene Symbol: CYGB
  Gene Name: cytoglobin
  ENST ID: ENST00000590175
  CDS Start-End: 243-620
aggatttaatttcagatcaactcatgattccagaacctgagttcttaccctctcggctatgactagagcagggcttgaagggggtgtagagtttgggaaggaagcaagaagcgaggaagacagaggcctaggagatgaagccgccagcctgagcaagcctggcagatagacatggccagacttggtaggggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggc

SEQ ID NO: 124590 - DNA, 815 bp, Homo sapiens
  Payload ID: 4473
  Gene Symbol: CYGB
  Gene Name: cytoglobin
  ENST ID: ENST00000589342
  CDS Start-End: 111-791
cccgcccgccgcgcacgcagccggccccggctcccggcgccccgcgccccgcgccccgcgccccgccaccgccgccgccgagcaaagccgggctgggcttggagctgctcatggagaaagtgccaggcgagatggagatcgagcgcagggagcggagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagcccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacagg

SEQ ID NO: 124591 - DNA, 788 bp, Homo sapiens
  Payload ID: 4473
  Gene Symbol: CYGB
  Gene Name: cytoglobin
  ENST ID: ENST00000589145
  CDS Start-End: 367-744
tgcaaattccagcttgtacttaaatacttcctgcgaagttttgactgagacgctgcaacaattcccgagctgtttcatcgtggcaccttcctggtggcaggtggattagcacattgtctgcaacccaggaggacttggaggaaagtcccagctctgctgattctagctgagtaaccttggcaaaggtcacctcacttctctctgagtcttattttctcatctgtaaaatgaggaggaggaggaggatcatccaaacatcacgggacttcgttaaatcagtgcttcggggcacttagcacagcgcctggcgcaaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaa

SEQ ID NO: 124592 - DNA, 3311 bp, Homo sapiens
  Payload ID: 4474
  Gene Symbol: CYTH1
  Gene Name: cytohesin 1
  Uniprot ID: Q15438
  ENST ID: ENST00000361101
  CDS Start-End: 72-1268
gcgagcgggggcgcgggtggcgcggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 124593 - DNA, 3311 bp, Homo sapiens; identical to SEQ ID NO: 124592
  Payload ID: 4474
  Gene Symbol: CYTH1
  Gene Name: cytohesin 1
  Uniprot ID: Q15438
  ENST ID: ENST00000446868
  CDS Start-End: 72-1268

SEQ ID NO: 124594 - DNA, 2159 bp, Homo sapiens
  Payload ID: 4474
  Gene Symbol: CYTH1
  Gene Name: cytohesin 1
  ENST ID: ENST00000589296
  CDS Start-End: 75-269
gaggcgagcgggggcgcgggtggcgcggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 124595 - DNA, 553 bp, Homo sapiens
  Payload ID: 4474
  Gene Symbol: CYTH1
  Gene Name: cytohesin 1
  ENST ID: ENST00000587308
  CDS Start-End: 242-553
acactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccgg

SEQ ID NO: 124596 - DNA, 3286 bp, Homo sapiens
  Payload ID: 4474
  Gene Symbol: CYTH1
  Gene Name: cytohesin 1
  Uniprot ID: Q15438
  ENST ID: ENST00000591455
  CDS Start-End: 50-1243
cggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 124597 - DNA, 3315 bp, Homo sapiens
  Payload ID: 4474
  Gene Symbol: CYTH1
  Gene Name: cytohesin 1
  Uniprot ID: Q15438
  ENST ID: ENST00000585509
  CDS Start-End: 253-1272
agtttaaccctaatggctacacaggagagaagcggcatgaatagacgggtttcccagggtgcggacggtgctttcccagaaactcccgggctgtgagttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 124598 - DNA, 1043 bp, Homo sapiens
  Payload ID: 4474
  Gene Symbol: CYTH1
  Gene Name: cytohesin 1
  ENST ID: ENST00000591574
  CDS Start-End: 67-102
cgggggcgcgggtggcgcggcgggacgcgagcggcgagccggagcgcggagcccggctcccgcaccatggaggaggacgacagctacgaggctgaaggatgagatagcagaagtagctaatgaaattgaaaacctgggatccacagaggaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacgggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctg

SEQ ID NO: 124599 - DNA, 3756 bp, Homo sapiens
  Payload ID: 4474
  Gene Symbol: CYTH1
  Gene Name: cytohesin 1
  Uniprot ID: Q15438
  ENST ID: ENST00000589297
  CDS Start-End: 694-1713
ggcattcttgcagtgaaagcaggcattaggcttttgcttctgagggagagaggaaagcaagtgcagcctgtgcgcaaatgctggtggtgcctcccctcccccccgggaggccgggaatgggggatagtaggaggggctggctgtgactgcattcatggaaatgagcctggaggagcggagcagcacacactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctgtccttgctccggctctccctgcacctacagctgtgggagctcccggcagcctggtactgtggggtcgctgcacggagccaccatggcctctgacgtggagagctgtgacctgccgaggctttgatgttgctgcccagggctggccaggacactggggccgcaggagaggggactcaccgtggttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 124600 - DNA, 568 bp, Homo sapiens
  Payload ID: 4474
  Gene Symbol: CYTH1
  Gene Name: cytohesin 1
  ENST ID: ENST00000590300
  CDS Start-End: 310-568
ttggtggctgcgagtgtactgagtaggaggcgagtccttcttggtgaaaaggctggagtgtccctcgtggaagtggagggcatgggatccctggaggaagggagcaaaggatactcctcctgaagcccctccaggacggtgttggagcagtctgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactac

SEQ ID NO: 124601 - DNA, 988 bp, Homo sapiens
  Payload ID: 4474
  Gene Symbol: CYTH1
  Gene Name: cytohesin 1
  ENST ID: ENST00000589768
  CDS Start-End: 172-988
attgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcg

SEQ ID NO: 124602 - DNA, 836 bp, Homo sapiens
  Payload ID: 4474
  Gene Symbol: CYTH1
  Gene Name: cytohesin 1
  ENST ID: ENST00000586043
  CDS Start-End: 254-836
agcacctcttcagctagttctggagtgggtgtgctgccctggatctcaaaggtgcagagcttggcctgccttctgctcctcctcactgctctccttggctgcccctgccataggtctcgtctttcttcctcctacagttctgccccctgcatgggcaggagataggggacggtccaagagcagcctcatgagagcagccaagacagagaagaagaagcctgccctcctaacacactgagttggcaccagaaggatgcactcgccaggaggcttgggtcggccgtgcctgctccagccttgccctgctgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacgg

SEQ ID NO: 124603 - DNA, 2260 bp, Homo sapiens
  Payload ID: 4475
  Gene Symbol: CYTIP
  Gene Name: cytohesin 1 interacting protein
  Uniprot ID: O60759
  ENST ID: ENST00000264192
  CDS Start-End: 123-1202
agaggtcacatgggctctttctgctttgctacttttgattacttgtcacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcgtgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaa

SEQ ID NO: 124604 - DNA, 757 bp, Homo sapiens
  Payload ID: 4475
  Gene Symbol: CYTIP
  Gene Name: cytohesin 1 interacting protein
  ENST ID: ENST00000418920
  CDS Start-End: 365-757
actttaggcaggtagtttggtgtgtgagctagtttcgaaccctgggaacattcctttccacatcgcctgagtctgacagcccggatcaaaaacaagcaggctttgtgtcaagacgtggcacgtgtcagagaatttgacgaatgacttttgattcaaaagaccgattggatgaaatcttgaagttcctaatagatgcactgatttccggcatactaaaaggcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccgg

SEQ ID NO: 124605 - DNA, 623 bp, Homo sapiens
  Payload ID: 4475
  Gene Symbol: CYTIP
  Gene Name: cytohesin 1 interacting protein
  ENST ID: ENST00000435117
  CDS Start-End: 516-623
ggtgtttagagggatgcagatgcttggccacccgtggaagtagctattggacagacacactcatccgtgaggacacatcaagctagatcctgaaggggagatagaagtgtcatataggcaaacggggagattggaattaaatgtcacgtggaaaaaagccaacatggcattctgttaagaagatagacaacctaagtgacgtctatcctgcttcaaagacaaaactcaggaggctgtacattcatttagagcagagtagacgaaacctcctattctctggcttgggaaccaggaggaatcactgactgagatttgccaaccagacctctatgaagtgagctctatcacatggtacgtttatgagaagaggaaccagcaatgtttccttccatcttcaactatactaacaagatccatctgatgtgctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcc

SEQ ID NO: 124606 - DNA, 561 bp, Homo sapiens
  Payload ID: 4475
  Gene Symbol: CYTIP
  Gene Name: cytohesin 1 interacting protein
  ENST ID: ENST00000439355
  CDS Start-End: 338-561
tttactgcctctctccagccagctccagcactacaggacagagattggaattaaatgtcacgtggaaaaaagccaacatggcattctgttaagaagatagacaacctaagtgacgtctatcctgcttcaaagacaaaactcaggaggctgtacattcatttagagcagagtagacgaaacctcctattctctggcttgggaaccaggaggaatcactgactgagatttgccaaccagacctctatggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcacttt

SEQ ID NO: 124607 - DNA, 845 bp, Homo sapiens
  Payload ID: 4475
  Gene Symbol: CYTIP
  Gene Name: cytohesin 1 interacting protein
  ENST ID: ENST00000457793
  CDS Start-End: 79-264
gtcacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagaatgacttttgattcaaaagaccgattggatgaaatcttgaagttcctaatagatgcactgatttccggcatactaaaaggcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgg

SEQ ID NO: 124608 - DNA, 1087 bp, Homo sapiens
  Payload ID: 4476
  Gene Symbol: CYTH2
  Gene Name: cytohesin 2
  ENST ID: ENST00000325139
  CDS Start-End: 326-1087
tcagtcgtagacttgtcgcgccgcttttgttgggcgctggacgggcttccggcggggcccgaaagccgggcgttccaggccattgtttgggctgagcctgtttccggtggcggcgggaggggcgggatggagtggtggaggcgaggccggggcggaaccattcccgctggaggggcgggcgagcccagcgcctgccggggccggggaggggcgcttgggttgcggggaggggagaaatcttggggggcgggggccttcgatgtcccgccccaccttcccaactctcctgagctgtcatcagttcccccggctgtagtgacttttcatggacccagtagtccggataaccaggtccccagctacctcgccagtaatggagtcagaaaaccaaggcctcagtccccttccaaaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcagg

SEQ ID NO: 124609 - DNA, 1546 bp, Homo sapiens
  Payload ID: 4476
  Gene Symbol: CYTH2
  Gene Name: cytohesin 2
  ENST ID: ENST00000391881
  CDS Start-End: 188-1066
cggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggtacggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatc

SEQ ID NO: 124610 - DNA, 4780 bp, Homo sapiens
  Payload ID: 4476
  Gene Symbol: CYTH2
  Gene Name: cytohesin 2
  Uniprot ID: Q99418
  ENST ID: ENST00000452733
  CDS Start-End: 477-1676
cctttgagcaggcgcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctggggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattcagggtcaaggtctagcattcattctagaagttacttgacagccatcagccagttacgctacagccatcagctagttcccatcgttgctttcatggggcttgaggtctttgaggggcaggagatgaagctggtgaggttgtgagctgggccagggctttgaggacaacctggagctggaagaacatgcgaccacctcagggagggtcagggaaggatgagtggggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggccacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgattttttttgtaggtttttttttttgttttttgttttgttttgttttgtttttgagagggagtctcactttgtgccctagactggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatattggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataaggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagca

SEQ ID NO: 124611 - DNA, 746 bp, Homo sapiens
  Payload ID: 4476
  Gene Symbol: CYTH2
  Gene Name: cytohesin 2
  ENST ID: ENST00000595765
  CDS Start-End: 1-645
ctgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctgggtacgtgccctcccgaccccgctggtccctccgcaggaggacatttgtgggcctgggccctggactcagcttccgcacacacctgctgcctgaactgaggcaaatgattcgacctctctgaacctcagttttccacacccaaaaaatggggctgaaaataaaatcaggcctgtgtgctgggcctggcctgtagtaagta

SEQ ID NO: 124612 - DNA, 2020 bp, Homo sapiens
  Payload ID: 4476
  Gene Symbol: CYTH2
  Gene Name: cytohesin 2
  ENST ID: ENST00000620214
  CDS Start-End: 1255-1674
gctgaaaataaaatcaggcctgtgtgctgggcctggcctgtagtaagtacttcccaaccccttctcttgacccacaaatgttgatggagcccttctgtgccaggccctgagctgggctgaggaggcagtgagaggcagctgacattgtcctttcgtgggagaagagttcactcaggcttctttccactgcgttaacccagcccgagggagccaaacccctggaatctattccccttggcaagaactcccagggttccaggcaggactgaccccgcactccgaggcatcaggcccagagcacttggctgatccaggtgccatccttcccgaaacaccacccacaggcagaaaagagccaaacaggccaggaaacctgtcccagattctggcttccagctgtggagggaatagccagggctggtgcagatgagtcgggaaacccagcagagatggaggggggagtcttcgtcataacacgtggcactggcacattcaaggtcggttagcatggatcagacaggatcgtagcatgatgaggggttagcacaaggactagagtggttctcagccctggctgtacatgagatttgcctgggcaactcgaaaactccggtggctgggccatagactcctgaagtcaggctctcaggagcagaagggccatcagtcatcgtttaagctcctcgggtgctcccaatgcatagtcaaggttgagagctactggcctggagccgtgcctggtaacagtaggtgccacctgcgtgttagatgtggtttataatggagacacggtgcacagctgctccagagagacacatctgggcagttacagtccagcacagcagtggaggcttcccgcggcagcaggagagcccacaggaagctttcagctcagtgaagggagtcaaggtcaggcttcttggaaggaggttggacagggcagctttggcctctgagtcttgggggcctccccatgtggaactgtgctcttaaaccagggcatcaccacctcaacagatgccagggtttcctggtaaatgtaaaatacacaagtcaggcagggcacaggggcccacccctgtaatttcagcactttgggaggacaaggcaggaggattgttagaggtcaggagtttgagaccaacctgggcaatataatgataccccccatctctacaaaaaataaaaaaattagccaggcatggtgatgtgggaggattgtttgagctcaagtggtcgaggcttcagtgagtcatggttgcgccactgcagtccagcctgggcaacagagcgagaccccgtctctataaaataaaacatgcaaatcactgtccagccaacaccccagtccagatccctgcattcgatccaagggaggcagactgctgggggaaattgagagtcctcgaggtgcccctggcagtgagcggccagaaagagaagcaggaaggcgccagcatcacgaggaactgcttccctcaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagc

SEQ ID NO: 124613 - DNA, 4606 bp, Homo sapiens
  Payload ID: 4476
  Gene Symbol: CYTH2
  Gene Name: cytohesin 2
  ENST ID: ENST00000427476
  CDS Start-End: 301-1503
atacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctggcagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattcagggtcaaggtctagcattcattctagaagttacttgacagccatcagccagttacgctacagccatcagctagttcccatcgttgctttcatggggcttgaggtctttgaggggcaggagatgaagctggtgaggttgtgagctgggccagggctttgaggacaacctggagctggaagaacatgcgaccacctcagggagggtcagggaaggatgagtggggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggccacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgattttttttgtaggtttttttttttgttttttgttttgttttgttttgtttttgagagggagtctcactttgtgccctagactggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatattggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataaggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagc

SEQ ID NO: 124614 - DNA, 4505 bp, Homo sapiens
  Payload ID: 4477
  Gene Symbol: CYTH3
  Gene Name: cytohesin 3
  Uniprot ID: O43739
  ENST ID: ENST00000350796
  CDS Start-End: 138-1337
ggaggaggcccggccgcgacccgggccgcgcgctgaggagccgcccggtcgcctgcgcgctccctccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaacaa

SEQ ID NO: 124615 - DNA, 4508 bp, Homo sapiens
  Payload ID: 4477
  Gene Symbol: CYTH3
  Gene Name: cytohesin 3
  Uniprot ID: O43739
  ENST ID: ENST00000396741
  CDS Start-End: 138-1340
ggaggaggcccggccgcgacccgggccgcgcgctgaggagccgcccggtcgcctgcgcgctccctccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggtggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaacaa

SEQ ID NO: 124616 - DNA, 3206 bp, Homo sapiens
  Payload ID: 4478
  Gene Symbol: CYTH4
  Gene Name: cytohesin 4
  Uniprot ID: Q9UIA0
  ENST ID: ENST00000248901
  CDS Start-End: 188-1372
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgccttttgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtgccctctgccaagtcatgcccattctctagttcttgcaaaactgcagtgtttggactagaaacgtattggcccctgctagccctgtgctccagcttccagctggagatggcagccgttgtttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggctgcctggaggcagtggctgagccagaaagtaacacagagctcatgcttggagagagagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggccgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggacaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaactcg

SEQ ID NO: 124617 - DNA, 636 bp, Homo sapiens
  Payload ID: 4478
  Gene Symbol: CYTH4
  Gene Name: cytohesin 4
  ENST ID: ENST00000405206
  CDS Start-End: 84-557
gcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcagattccgagaaggagcatctgatctgggctttggagggtgagtaggagttcacaatacagagaaggaagaagccaccaccatccagtgttctctaactcccagctctttaagggagaggg

SEQ ID NO: 124618 - DNA, 633 bp, Homo sapiens
  Payload ID: 4478
  Gene Symbol: CYTH4
  Gene Name: cytohesin 4
  ENST ID: ENST00000402997
  CDS Start-End: 96-560
agtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcagggttgtgaagactaaatgggaaagtgtttaaaactggtccacagtgagtgcttagtaagtcttgatgctgcttgaaaactcagattccgagaaggagcatctga

SEQ ID NO: 124619 - DNA, 652 bp, Homo sapiens
  Payload ID: 4478
  Gene Symbol: CYTH4
  Gene Name: cytohesin 4
  ENST ID: ENST00000457992
  CDS Start-End: 300-652
aagtgggagttggaagagagcttgtggggtggaacacagggggccctgctaggactgtccaagttgggcgctcctatggcatatatgtgaggaggctgccacgtgaatgcccatggtcccctggaaaatgttcgtcctcagtgaacatcgccctcggtgtctgtgcatgtggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagag

SEQ ID NO: 124620 - DNA, 569 bp, Homo sapiens
  Payload ID: 4478
  Gene Symbol: CYTH4
  Gene Name: cytohesin 4
  ENST ID: ENST00000446506
  CDS Start-End: 1-442
cacacacacttccggaagcctctccagcagggacagccaagccggggacagcgcctccagggcagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacct

SEQ ID NO: 124621 - DNA, 2182 bp, Homo sapiens
  Payload ID: 4479
  Gene Symbol: CIAPIN1
  Gene Name: cytokine induced apoptosis inhibitor 1
  Uniprot ID: Q6FI81
  ENST ID: ENST00000394391
  CDS Start-End: 243-1181
ccagataccgccgccgccgccattttggaagcgggcacgtcgcccacggcgacgcgaccggtagctacgggaccacggccctaaggagggcggaagtcgtcgctccgtggagcctcctcctctcgcgagaggcgcaaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaacttga

SEQ ID NO: 124622 - DNA, 1137 bp, Homo sapiens
  Payload ID: 4479
  Gene Symbol: CIAPIN1
  Gene Name: cytokine induced apoptosis inhibitor 1
  ENST ID: ENST00000568940
  CDS Start-End: 83-883
gaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttct

SEQ ID NO: 124623 - DNA, 1814 bp, Homo sapiens
  Payload ID: 4479
  Gene Symbol: CIAPIN1
  Gene Name: cytokine induced apoptosis inhibitor 1
  ENST ID: ENST00000565961
  CDS Start-End: 121-840
tcgcgagaggcgcaaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttata

SEQ ID NO: 124624 - DNA, 505 bp, Homo sapiens
  Payload ID: 4479
  Gene Symbol: CIAPIN1
  Gene Name: cytokine induced apoptosis inhibitor 1
  ENST ID: ENST00000563341
  CDS Start-End: 119-505
ggctggagagaagccgggagcgagcccaggcggcagattaaattgcactttgtctctgcccagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagag

SEQ ID NO: 124625 - DNA, 2016 bp, Homo sapiens
  Payload ID: 4479
  Gene Symbol: CIAPIN1
  Gene Name: cytokine induced apoptosis inhibitor 1
  Uniprot ID: Q6FI81
  ENST ID: ENST00000567518
  CDS Start-End: 134-1033
gagcctcctcctctcgcgagaggcgcaaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatgtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgata

SEQ ID NO: 124626 - DNA, 1559 bp, Homo sapiens
  Payload ID: 4479
  Gene Symbol: CIAPIN1
  Gene Name: cytokine induced apoptosis inhibitor 1
  ENST ID: ENST00000569370
  CDS Start-End: 121-921
tcgcgagaggcgcaaggcgtggagtcgacggctggagagaagccgggagcgagcccaggcggcagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatctt

SEQ ID NO: 124627 - DNA, 641 bp, Homo sapiens
  Payload ID: 4479
  Gene Symbol: CIAPIN1
  Gene Name: cytokine induced apoptosis inhibitor 1
  ENST ID: ENST00000565786
  CDS Start-End: 496-641
ggagcctcctcctctcgcgagaggcgcaaggcgtggagtcgacggctggagagaagccgggagcgagcccaggcggcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggcct

SEQ ID NO: 124628 - DNA, 328 bp, Homo sapiens
  Payload ID: 4479
  Gene Symbol: CIAPIN1
  Gene Name: cytokine induced apoptosis inhibitor 1
  ENST ID: ENST00000567751
  CDS Start-End: 113-328
agccgggagcgagcccaggcggcagtcttgattcccttttggccagcagtttttagtgaaacctgctgtggaccctgctgctgccaagctgtggaccctctcagccaacgatatggaggacgacagcatggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaac

SEQ ID NO: 124629 - DNA, 994 bp, Homo sapiens
  Payload ID: 4479
  Gene Symbol: CIAPIN1
  Gene Name: cytokine induced apoptosis inhibitor 1
  ENST ID: ENST00000570000
  CDS Start-End: 59-625
cagtcttgattcccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcaggatctcattgactcagatgagctgctggatccagaagatttgaagaagccagatccagcttccctgcgggctgcttcttgtggggaagggaaaaagaggaaggcctgtaagaactgcacctgtggccttgccgaagaactggaaaaagagaagtcaagggaacagatgagctcccaacccaagtcagcttgtggaaactgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctc

SEQ ID NO: 124630 - DNA, 896 bp, Homo sapiens
  Payload ID: 4479
  Gene Symbol: CIAPIN1
  Gene Name: cytokine induced apoptosis inhibitor 1
  ENST ID: ENST00000569979
  CDS Start-End: 48-788
cccttttggccagcagtttttaggtctgtcagtactgcactgcaagaatggcagattttgggatctctgctggccagtttgtggcagtggtctgggataagtcatccccagtggaggctctgaaaggtctggtggataagcttcaagcgttaaccggcaatgagggccgcgtgtctgtggaaaacatcaagcagctgttgcaatctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtagataacaatagcaaagtgaagacagcatctaagctgtgttcagccctgactctttctggtcttgtggaagtgaaagagctgcagcgggagcccctaacccctgaggaagtacagtctgttcgagaacaccttggtcatgaaagtgacaacctgctgtttgttcagatcacaggcaaaaaaccaaactttgaagtgggttcttctaggcagcttaagctttccatcaccaagaagtcttctccttcagtgaaacctgctgtggaccctgctgctgccaagctgtggaccctctcagccaacgatatggaggacgacagcatgtgctacctgggcgatgccttccgctgtgccagctgcccctaccttgggatgccagccttcaaacctggggaaaaggtgcttctgagtgatagcaatcttcatgatgcctaggaggttcctgacatgggacccatctgctcctccagccaactcctgtccctcacatcccaccatggtggctcctcccacctcctctggatttgttcactctgagatctg

SEQ ID NO: 124631 - DNA, 2043 bp, Homo sapiens
  Payload ID: 4480
  Gene Symbol: CISH
  Gene Name: cytokine inducible SH2-containing protein
  Uniprot ID: Q9NSE2
  ENST ID: ENST00000348721
  CDS Start-End: 182-958
cccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttatttta

SEQ ID NO: 124632 - DNA, 2167 bp, Homo sapiens
  Payload ID: 4480
  Gene Symbol: CISH
  Gene Name: cytokine inducible SH2-containing protein
  Uniprot ID: Q9NSE2
  ENST ID: ENST00000443053
  CDS Start-End: 229-1056
tccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctt

SEQ ID NO: 124633 - DNA, 1792 bp, Homo sapiens
  Payload ID: 4481
  Gene Symbol: CRLF1
  Gene Name: cytokine receptor-like factor 1
  Uniprot ID: O75462
  ENST ID: ENST00000392386
  CDS Start-End: 195-1463
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgc

SEQ ID NO: 124634 - DNA, 520 bp, Homo sapiens
  Payload ID: 4481
  Gene Symbol: CRLF1
  Gene Name: cytokine receptor-like factor 1
  ENST ID: ENST00000597131
  CDS Start-End: 1-520
gccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggaagcgcccgggcccgggcggcggggcgtgcgaaccgcggggcggagagccgagctcggggccggtgcggcgcga

SEQ ID NO: 124635 - DNA, 1545 bp, Homo sapiens
  Payload ID: 4482
  Gene Symbol: CRLF2
  Gene Name: cytokine receptor-like factor 2
  Uniprot ID: Q9HC73
  ENST ID: ENST00000381566
  CDS Start-End: 4-1119
ggcatggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtgatggacacaccactgtcaaagtcaacgtcaggatccacgttgacatttaaagacagaggggactgtcccggggactccacaccaccatggatgggaagtctccacgccaatgatggtaggactaggagactctgaagacccagcctcaccgcctaatgcggccactgccctgctaactttcccccacatgagtctctgtgttcaaaggcttgatggcagatgggagccaattgctccaggagatttactcccagttccttttcgtgcctgaacgttgtcacataaaccccaaggcagcacgtccaaaatgctgtaaaaccatcttcccactctgtgagtccccagttccgtccatgtaccattcccatagcattggattctcggaggattttttgtctgtttgagactccaaaccacctctacccct

SEQ ID NO: 124636 - DNA, 1013 bp, Homo sapiens
  Payload ID: 4482
  Gene Symbol: CRLF2
  Gene Name: cytokine receptor-like factor 2
  Uniprot ID: Q9HC73
  ENST ID: ENST00000381567
  CDS Start-End: 234-1013
atggggcggctggttctgctgtggggagctgccgtctttctgctgggaggctggatggctttggggcaaggaggagcagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtga

SEQ ID NO: 124637 - DNA, 1639 bp, Homo sapiens
  Payload ID: 4482
  Gene Symbol: CRLF2
  Gene Name: cytokine receptor-like factor 2
  Uniprot ID: Q9HC73
  ENST ID: ENST00000400841
  CDS Start-End: 117-1232
tttccctagtttcctttctgactttttaaaatcgatggtgacctctgcttatgagtcatgagtgatctgttcgttgtaggtccctgaggacctcactctccactcctgtttcaggcatggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtgatggacacaccactgtcaaagtcaacgtcaggatccacgttgacatttaaagacagaggggactgtcccggggactccacaccaccatggatgggaagtctccacgccaatgatggtaggactaggagactctgaagacccagcctcaccgcctaatgcggccactgccctgctaactttcccccacatgagtctctgtgttcaaaggcttgatggcagatgggagccaattgctccaggagatttactcccagttccttttcgtgcctgaacgttgtcacataaaccccaaggcagcacgtccaaaatgctgtaaaaccatcttcccactctgtgagtccccagttccgtccatgtaccattcccatagcattggattctcggaggattttttgtctgttttgagac

SEQ ID NO: 124638 - DNA, 1789 bp, Homo sapiens
  Payload ID: 4482
  Gene Symbol: CRLF2
  Gene Name: cytokine receptor-like factor 2
  ENST ID: ENST00000467626
  CDS Start-End: 90-788
aaaatcgatggtgacctctgcttatgagtcatgagtgatctgttcgttgtaggtccctgaggacctcactctccactcctgtttcaggcatggggcggctggttctgctgtggggagctgccgtctttctgctgggaggctggatggctttggggcaaggaggagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtgatccacccgcctcagcctcccaaagcgttgggtttacaggagtgagccactgtgtccggcctcgcggctccattcttgaagtcagcgagactgtgaaccctccggaaggaaaactctggacagacagatgcctgtgcagagacaccaacgcctcccaaaccaaagctgtccaaatttattttaatttccagcctggccatccttctgatggtgtctctcctccttctgtctttatggaaattatggagagtgaagaagtttctcattcccagcgtgccagacccgaaatccatcttccccgggctctttgagatacaccaagggaacttccaggagtggatcacagacacccagaacgtggcccacctccacaagatggcaggtgcagagcaagaaagtggccccgaggagcccctggtagtccagttggccaagactgaagccgagtctcccaggatgctggacccacagaccgaggagaaagaggcctctgggggatccctccagcttccccaccagcccctccaaggcggtgatgtggtcacaatcgggggcttcacctttgtgatgaatgaccgctcctacgtggcgttgtgatggacacaccactgtcaaagtcaacgtcaggatccacgttgacatttaaagacagaggggactgtcccggggactccacaccaccatggatgggaagtctccacgccaatgatggtaggactaggagactctgaagacccagcctcaccgcctaatgcggccactgccctgctaactttcccccacatgagtctctgtgttcaaaggcttgatggcagatgggagccaattgctccaggagatttactcccagttccttttcgtgcctgaacgttgtcacataaaccccaaggcagcacgtccaaaatgctgtaaaaccatcttcccactctgtgagtccccagttccgtccatgtaccattcccatagcattggattctcggaggattttttgtctgttttgag

SEQ ID NO: 124639 - DNA, 2957 bp, Homo sapiens
  Payload ID: 4483
  Gene Symbol: CRLF3
  Gene Name: cytokine receptor-like factor 3
  Uniprot ID: Q8IUI8
  ENST ID: ENST00000324238
  CDS Start-End: 126-1454
tcgtcgtggggcatggggcggcggggctgggcggtgcttccgcctgcgcgaggccgcgccgggccgcttggaggcgcccggtgcagtcgggaacccgcgctaggtttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcagatcaaagaaagtgcatcacagacaagggatgttctcaaacagcattttaatgatttaaagggaacccttggaaagctcctggatgagcgattggtgacccttttgcaagaggtggacaccattgaacaggagaccattaaaccactagatgactgccagaagctcatagaacacggagtcaacactgcagaggacttagtccgagaaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcattaaaagtatagaagatataggaagttctatacccttccactgtacttctcaaagttggttattagaccaggaaaacttaatgtaatattatttttaaaatcatcttaaaggatccaagtccatgtaactctttagaacaagaggaataggtcagatagaagaagctgtgtaatgtattaatacatccgttcatgtgctgtccacatgaatgtgttgactgtgctctccatgttcaggtatttgtaagcagtgttgacttttatcccctcttcagtaatctttaagtccccaaaacattataactttttctttttttgttgagacggagtctcactcttgtcactcaggctggagtgcagtggtgtgatctcagttcactgcaacctctgcctcccacgttcaagcgatcctcctgcctcaggctcctgagtagctgggattacaggcgtcggccaccacacctggctaatttttgtatttttagtagagacagggtttcaccatgttggccaggctggtcttgaactcctgacctcaggtgttccacccacctcagccttccaaagtgctaggattacaggtgtgagccactgcagtggaccaatttttgtatttttttaaatgcttgaccaagtgtctaaaataggcaagtagtaccttttgttctttcattgcaatttgatacagtataggctacagtatttttacagggtaaaactagttatggcagtagtatgcacagcagtgttagccatttcatatgtatgtaatatgcacgtgtgtatccaatctgcctgtgacatgcattttactctttgcagagaatgagctgcagtccagtttaatgtcagtttaataagtggtctctttttagcagagcaaaaaaatatagcgtaaatacttattttttttaaaaacttacttaaatttgtgtgtaaaatatttatttgaaggactttaatatgtaaaaataattgtcttctatgccaccctacagattttattttaatgtgaattatttttttcatttcatttttaccagtatagtaaaaaagtagaaaagcaagtatgatatttttgtaagataatttatttggggattcatgttccctgttagacaatcatgaccttttctacttgtctttttatatataagtagtagatttccacttgtttagggattaagaagatgttctagaatgtagataccttgtccagccataggaatcaaaataaaaaactaaaaaagttca

SEQ ID NO: 124640 - DNA, 1392 bp, Homo sapiens
  Payload ID: 4483
  Gene Symbol: CRLF3
  Gene Name: cytokine receptor-like factor 3
  ENST ID: ENST00000578692
  CDS Start-End: 21-311
ttcgccggccgcgcggccagatgaggggggcgatggagctggagcctgagctgctgttgcaggaggcccgcgagaacgtggaggcagcgcagagctaccggcgggagctgggtcaccggcttgaggggctgcgtgaggcgcggaggcaggtgaaatcgccatgcttggtggtgtgggagaagagaatgagaaactgtggagctttaccaaaaaggcctcgcacattcagttggacagcttaccagaagtacctttactggttgatgtgccttgtttatctgctcagttggatgactcaattcttaacatagtgaaagaccacatttttaagcatggaacagtagcatctcgcccaccagtacagatagaagaactaatagagaaacctggaggcatcattgtacgatggtgtaaggtggatgatgactttacagcccaagattacaggctccagtttcgtaaatgtacttcaaatcattttgaggatgtatatgtaggttctgaaactgaattcatagtattgcacatagaccccaacgttgattaccagttcagagtctgcgcccgaggagatggccgacaggagtggagtccttggagtgtcccccagataggtcattccacattggtgcctcatgagtggacagctggttttgaggggtacagtctgagcagtcgaagaaatatagcacttcggaacgattctgaatcatcgggtgttctctactccagagctccgacttatttctgtgggcagacattaacattcagagttgaaactgtgggacagccagacagaagagatagcataggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagtaactataagttcaaataatagagaagtggtttttgactggttacttgatcagtcttgtggttctctttactttggatgctcatttttctatcctggatggaaagtgttagtgttttagatgtttgggtgcttggctttggttttcagggtctaacgtagctgtcctcagcccagcgtagttgtaattgctttaaaaaaaaagttgaattcatctctaacttaggccattggaaagtgtttactggattcattttgtaatattttagcaaaaagagacttcaatgttgtggacaaaatcatacaattcagtcaattttatttttagcatactgttaaatatcacatcacaataaaaatcaaattggcatt

SEQ ID NO: 124641 - DNA, 378 bp, Homo sapiens
  Payload ID: 4483
  Gene Symbol: CRLF3
  Gene Name: cytokine receptor-like factor 3
  ENST ID: ENST00000583527
  CDS Start-End: 1-356
taggagtgtgtgcagaaaaacaggatggatatgactctctgcagcgggatcaagctgtgtgcattagtacaaatggtgcagtttttgtcaatggaaaagaaatgacaaatcagttacccgcagttacttctgggtccactgtcacgtttgacattgaagccgtgactctaggaaccaccagtaataatgaaggtggacacttcaagcttcgagaacgaggtcttgctatgttgtccaaactggtctcaaactcctgggctcaaagtcttcgcaccttggactcccaaagtgttagggttacagagtctcgctgtcaccaggctggactgcagtggcacgatctcaactcactgtaacctccgcctcctgggttcaagc

SEQ ID NO: 124642 - DNA, 5599 bp, Homo sapiens
  Payload ID: 4484
  Gene Symbol: CLNK
  Gene Name: cytokine-dependent hematopoietic cell linker
  Uniprot ID: Q7Z7G1
  ENST ID: ENST00000226951
  CDS Start-End: 241-1527
ggctgcatttcacaggaaaccaagtctaaaacggacctatcaggaggttttctgctgaagggcactgcttagcatcgagaagaattcaacccaccgccttactaatttccagtgccccaaggtctctgcactgccgcccctcctcacaggagacggacacctcagcctagatcccttggtgctctccacgctgttcaggctgaattgaagatccctcttacccgccaggtgccaagaactatgaacaggcagggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaataaaaataaaaactagggttttaaaagtatcttctaaaaaacaacaacaaaaaatactataaacatagccattatgctcatgatacaggcgagcagcaaagggcaccagaagctgttgcttaaatgtttgcagtcagtgcaagacaagtctatgggaaattcccaaatctgtgctctttacaggacactgcgctgcctttatgtcagttgttgggccttacatatatacaatgtgtggatgatttcttacactaaagatgctgggctgggtgcggtgcctcatgcctgtaatcccagcactttgggaggctgaggtggacagatcacgaggtcaggagatcaagaccatcctggctaacatggtgaaaccccatgtctactaaaaatacaaaaaatcagctgggcgtggtggtgggtgcctgtagtcccagctactcgggaggctgaggcaggagaatggtgtgaacccgggaggcggagcttgcagtgagccgaaatcgcgccactgcactccaatccagcctggggacagagagactccgtctcaaaaaaaaaaaaaggtgttgggttggtgaatattagctctcttttattgtaatcctagaaattcaagtatagggaagaaatgtggtatggaaaaccagcaattgtgaatgtcaccttgaagacagaaactgaaaatcctctgactagggtgtgaaacggtcatgggaccagcctccagcatcatctgcttcaagtagctttaagtcaaatggaattaacacattcatagtacagagctcagattatatcctacactagccttcaggcaagcatatgtctgagggaaactaaaaattgtattaacaattccaattatggacttccattcaaagacagagaaaaactgtcctcaaattagtgctaattcttgcagtaacgttgcacaggccatgatattattccctgtagaggttaagaggatttaattttattattgttttacaataaagatgaggaaacagaggctcgaagtagctattgatcttactcaatatgagaagagagcccagattgtaatctgctttgcctggctccatgcaagctcatcttcccaggtacattctctgcgctgtgacattttacaatcaagttgaaaagctaatttaaaaaaaaagagagagagagagagaaagatagaaacaatttgaaaatacagatttaccaccttaaaataaataaactcttctagtgggaataagcttttttaaaaaacatactgtctgtcgaaaataacagtatatcatgatgtcaaatgctaccaaagcttacaaaggaaattcatagagtatttatgtaattgtagcattgatgcagaaagaaaaccaaaaataattaaaaggcaatagaagcaaatgaaaacaataaaaacaatgtgcaggattatctcttttgtaagacagcagacaatgagctctctgggaaaagctcttagcatctacccactatccaaatacctgctcaggtgttctcctttcacaaggtcaatgtgaagtgatgcctataagttacatcaggagcatttaatgaagaagctatttgtaaagctggaacttttgagacccagctgagcctatcgtagagtatgcctgcagaggattacatagaaccaagagacaagagtgtttaaattggagcttggatacgaaagaactcactggtccggtcaaagctaaaagctgtatggttgctggtcattctctactggaattcaacaagccagggacagtatggaaacaaggactttacagaagagctccaggctcacattaagaaggaatctgaccctcaccctaaaaagctattgggagattactgatacctccaactcactgattcattgaggccatgccattcaatgctatgttctcaagaaatgtctatgagtcctctcaaccattgctgttgataaaataggtgaatgtcaagtgggggttagcatttgataaggtgtacgtttgaaataatattttatcgtctcttgttcacaaatacaacatataattccaagaagaaaaaagaagtagaaattcagcatccttaagatgacagcaagaatgaggggaaaaggaagaaaaaaaagaaattaaacatcttgcaataaaaagcttacaatatttttgtgtatttgaacacttctgtaaaaaatataaaatggaaaatactgacatgggctgcttctggtgattggggtttgagggattgggtgtcgggttttctagaactcagacaccaggacaaagttagaagtgcaaacactgattggaggttaatgtttgagaaagataaaagggagaagaaacagaagtatgggtatggggtgggctttcaggctcccacctgtgagagggaagaggggaggtgtggggagtgaggagaaaaagcatgagattcagacacagctctgggagagttttggccagctcatagtgaggcccaaagcaaagtttgcccagagaggagacagtgttatgctgggcagtaatgtctgggtcttagtgccccatcctgttaagtcattgtctggggctatcctgggaaaaagaaaaacaacaaaaaaaaaagacctgcaaatgctgtggccaatccagaaggcgcagctggacgctgtccactaacttgctggccagcaagttatttcaatggagactcaagagacccacctctggcctgccacagcaacatcctgaattcactgttttcagtgttgattgtagtaaggacaatcacatttacattttgcttgtaatggatgattaaataataagagtatataaattcgattgtatttgtttcttacaacacttctgtaaagaagagagggcagctatttctaatgcattttataattgaggaaattgtacctcattggccaaaatctcacagtgacatagtcgcgactggaaccaaggtctccatatgcaattatcctattcatggtctacctgctttattagatctgtaattgaatattcaatgatttggatttggcatgcccaaattccagtgttttaatcccttttcaaccattacctcacgtttagtttaaaagtatcacttgatatctgatttcaatagagtaatagaattttagctttatccaattacagcatttatgctttccagatattttttggactaaataattctcattctgtataaatgtgcatagccctcatcattagtcatatattgtgttagcacctttgtgtactgcatgtgtattcattactaagcactattgtagatgttgaaaatagagcagtgaataagagagatagatgacaaataaatatacaaacaaataagataatctaagtcagtttcccattactggattggatttctattttaacacttatttctgagtacttgtggggtgatgccaacattaaatgttttgaggaagctcctttgagatggctttgaaaagtcctaagtgagaaaatttaaaattttcccaaacttatttatgtggggtgtgcatgtgtgtgcctgtgcctgtgtgcgtgtgtgtgtgtgtgtttttaagtaaccgcatcatggctgtaatcagttaagtctcctgttctaattactacggaggaatcaaatgaaccccattgtcgaatgtagccaattatgtatgtgtgtacacaaatacaaatttttatgatagcctatattgtatattagcattatatttgtatatcttttttattctgagcaatatttgttctagctaagcacatttacattcataatttacagccttactaatgtaaataaaagtaaatatgtaattgaatgtta

SEQ ID NO: 124643 - DNA, 1539 bp, Homo sapiens
  Payload ID: 4484
  Gene Symbol: CLNK
  Gene Name: cytokine-dependent hematopoietic cell linker
  ENST ID: ENST00000442825
  CDS Start-End: 1-1287
atgaatcccaggggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgaggtccttgaagcagaaaaagttcctcataaccagaggaagcctgaatcaactcatctgttagaaaaccaaaatactcaagagattccacttgccattagcagttcttcattcacgacaagcaaccacagtgtgcaaaacagagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaataaaaataaaaact

SEQ ID NO: 124644 - DNA, 1143 bp, Homo sapiens
  Payload ID: 4484
  Gene Symbol: CLNK
  Gene Name: cytokine-dependent hematopoietic cell linker
  Uniprot ID: Q7Z7G1
  ENST ID: ENST00000507719
  CDS Start-End: 294-803
gacaaagtcatgccagtccttccatactggcagttttaatttttacgaaaccacattcttcacgatgcctgatgctgtgcagaagagcgtagtctagaagaaagaacacggattttggagacaggcattcctctcaaccccaaacctgccatctcctagccatgtaactttggacaaggggcaatagaaagacaactaaagaaggatccaacgatttgaaattccagaacttcagtctgccaaaaaacaggtcatggcctcgcatcaatagtgccacaggccagtaccagaggatgaacaagcctcttctagactgggaaagaaactttgctgcagtcctggatggagcaaaaggccacagtgatgatgactatgatgaccctgagcttcggatggaagagacatggcagtcgattaaaattttaccagcccggcctataaaggaatctgaatatgcagatacacactatttcaaggttgcaatggacactccccttccgttagacaccaggacctctatctccattggacagccgacctggaacacacagacgaggttggaaagagtggacaaacccatttccaaggacgtcagaagccaaaacattaaaggagatgcatccgtaagaaagaacaagattcctttaccacctcctcggcctctcataacacttccgaagaagtaccaacccttgccccctgagccggagagcagcaggccacctttatctcagagacacacctttccagaagtccagagaatgcccagtcagataagcttaagggacttaagtgagccataaaatagggatgggggccaggtgcagtggctcacgcctgtaatcccagcactttgggaggccgaggtgggcggatcacctgaggtcaggggttcaagatcagcctgaccaacatgaagaaaccccatctctacaaaaaatacaaaattagccaggtgtggtggcgcatgcctgtaatcccagccacgctactcgggaggctgaggaaggagaatcgcttgaacccaggaggcagaggttacggtgagccaagatcatgccattgtactccagcttgggcaacaagagcgaagctccatctcaaaataaataaattaattaaataaataaaaataaaataaaa

SEQ ID NO: 124645 - DNA, 4180 bp, Homo sapiens
  Payload ID: 4484
  Gene Symbol: CLNK
  Gene Name: cytokine-dependent hematopoietic cell linker
  ENST ID: ENST00000515667
  CDS Start-End: 87-587
gtcattatatgttagaagtgcaatcagtacataactggaatttttaaatcaatctgtaactgattttaaaagatcatagaggaggcatgcagccctgttctcctcagagatgccagcctccagccagctgcagccctcacgaaaatatactgccctataaatacacaagctggagaccacctttccccaaaaggtctgatagaaaggatgtccagcacaatgaatggtacattggagaatacagccgccaggcagtggaagaggcattcatgaaggagaacaaggatggtagtttcttggtccgagattgttccacaaaatccaaggaagagccctatgttttggctgtgttttatgagaacaaagtctacaatgtaaaaatacgcttcctggagaggaatcagcagtttgccctggggacaggactcagaggagatgagaagtttgattcagtagaagacatcatcgaacactacaagaattttcccattatactaattgatgggaaagataaaactggggtccacaggaaacagtgtcacctcactcagccactccctctcaccagacacctcttgcctctgtagcctggtctttgtgttatctttggtttactggattcagcgcttccattgttttcattgatttcaaaagtttattttctgtgccttcaagggacaacttttttaactttggagaaaagaaaaacactctataacagagagtggaaaatcactcacggttttgaaagttcaaaccacagagaaaatatttataacatgcaaaaaataaaaacattctagtaactggccactggaaaataaataaaaataaaaactagggttttaaaagtatcttctaaaaaacaacaacaaaaaatactataaacatagccattatgctcatgatacaggcgagcagcaaagggcaccagaagctgttgcttaaatgtttgcagtcagtgcaagacaagtctatgggaaattcccaaatctgtgctctttacaggacactgcgctgcctttatgtcagttgttgggccttacatatatacaatgtgtggatgatttcttacactaaagatgctgggctgggtgcggtgcctcatgcctgtaatcccagcactttgggaggctgaggtggacagatcacgaggtcaggagatcaagaccatcctggctaacatggtgaaaccccatgtctactaaaaatacaaaaaatcagctgggcgtggtggtgggtgcctgtagtcccagctactcgggaggctgaggcaggagaatggtgtgaacccgggaggcggagcttgcagtgagccgaaatcgcgccactgcactccaatccagcctggggacagagagactccgtctcaaaaaaaaaaaaaggtgttgggttggtgaatattagctctcttttattgtaatcctagaaattcaagtatagggaagaaatgtggtatggaaaaccagcaattgtgaatgtcaccttgaagacagaaactgaaaatcctctgactagggtgtgaaacggtcatgggaccagcctccagcatcatctgcttcaagtagctttaagtcaaatggaattaacacattcatagtacagagctcagattatatcctacactagccttcaggcaagcatatgtctgagggaaactaaaaattgtattaacaattccaattatggacttccattcaaagacagagaaaaactgtcctcaaattagtgctaattcttgcagtaacgttgcacaggccatgatattattccctgtagaggttaagaggatttaattttattattgttttacaataaagatgaggaaacagaggctcgaagtagctattgatcttactcaatatgagaagagagcccagattgtaatctgctttgcctggctccatgcaagctcatcttcccaggtacattctctgcgctgtgacattttacaatcaagttgaaaagctaatttaaaaaaaaagagagagagagagagaaagatagaaacaatttgaaaatacagatttaccaccttaaaataaataaactcttctagtgggaataagcttttttaaaaaacatactgtctgtcgaaaataacagtatatcatgatgtcaaatgctaccaaagcttacaaaggaaattcatagagtatttatgtaattgtagcattgatgcagaaagaaaaccaaaaataattaaaaggcaatagaagcaaatgaaaacaataaaaacaatgtgcaggattatctcttttgtaagacagcagacaatgagctctctgggaaaagctcttagcatctacccactatccaaatacctgctcaggtgttctcctttcacaaggtcaatgtgaagtgatgcctataagttacatcaggagcatttaatgaagaagctatttgtaaagctggaacttttgagacccagctgagcctatcgtagagtatgcctgcagaggattacatagaaccaagagacaagagtgtttaaattggagcttggatacgaaagaactcactggtccggtcaaagctaaaagctgtatggttgctggtcattctctactggaattcaacaagccagggacagtatggaaacaaggactttacagaagagctccaggctcacattaagaaggaatctgaccctcaccctaaaaagctattgggagattactgatacctccaactcactgattcattgaggccatgccattcaatgctatgttctcaagaaatgtctatgagtcctctcaaccattgctgttgataaaataggtgaatgtcaagtgggggttagcatttgataaggtgtacgtttgaaataatattttatcgtctcttgttcacaaatacaacatataattccaagaagaaaaaagaagtagaaattcagcatccttaagatgacagcaagaatgaggggaaaaggaagaaaaaaaagaaattaaacatcttgcaataaaaagcttacaatatttttgtgtatttgaacacttctgtaaaaaatataaaatggaaaatactgacatgggctgcttctggtgattggggtttgagggattgggtgtcgggttttctagaactcagacaccaggacaaagttagaagtgcaaacactgattggaggttaatgtttgagaaagataaaagggagaagaaacagaagtatgggtatggggtgggctttcaggctcccacctgtgagagggaagaggggaggtgtggggagtgaggagaaaaagcatgagattcagacacagctctgggagagttttggccagctcatagtgaggcccaaagcaaagtttgcccagagaggagacagtgttatgctgggcagtaatgtctgggtcttagtgccccatcctgttaagtcattgtctggggctatcctgggaaaaagaaaaacaacaaaaaaaaaagacctgcaaatgctgtggccaatccagaaggcgcagctggacgctgtccactaacttgctggccagcaagttatttcaatggagactcaagagacccacctctggcctgccacagcaacatcctgaattcactgttttcagtgttgattgtagtaaggacaatcacatttacattttgcttgtaatggatgattaaataataagagtatataaattcgattgtatttgtttcttacaacacttctgtaaagaagagagggcagctatttctaatgcattttataattgaggaaattgtacctcattggccaaaatctcacagtgacatagtcgcgactggaaccaaggtctccatatgcaattatcctattcatggtctacctgctttattagatctgtaattgaatattcaatgatttggatttggcatgcccaaattccagtgttttaatcccttttcaaccattacctcacgtttagtttaaaagtatcacttgatatctgatttcaatagagtaatagaattttagctttatccaattacagcatttatgctttccagatattttttggactaaataattctcattctgtataaatgtgcatagccctcatcattagtcatatattgtgttagcacctttgtgtactgcatgtgtattcattactaagcactattgtagatgttgaaaatagagcagtgaataagagagatagatgacaaataaatatacaaacaaataagataa

SEQ ID NO: 124646 - DNA, 1003 bp, Homo sapiens
  Payload ID: 4485
  Gene Symbol: CYTL1
  Gene Name: cytokine-like 1
  Uniprot ID: Q9NRR1
  ENST ID: ENST00000307746
  CDS Start-End: 28-438
ggcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactacagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacttgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaa

SEQ ID NO: 124647 - DNA, 285 bp, Homo sapiens
  Payload ID: 4485
  Gene Symbol: CYTL1
  Gene Name: cytokine-like 1
  ENST ID: ENST00000509419
  CDS Start-End: 1-278
ggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacgatttggtattcctgttggatgactgcaatgccttggaatacccaatcccagtgactacggtcctgccagatcgtcagcgctaagggaact

SEQ ID NO: 124648 - DNA, 553 bp, Homo sapiens
  Payload ID: 4485
  Gene Symbol: CYTL1
  Gene Name: cytokine-like 1
  ENST ID: ENST00000506508
  CDS Start-End: 1-229
gcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggatttggtattcctgttggatgactgcaatgccttggaatacccaatcccagtgactacggtcctgccagatcgtcagcgctaagggaactgagaccagagaaagaacccaagagaactacagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacttgcaca

SEQ ID NO: 124649 - DNA, 707 bp, Homo sapiens
  Payload ID: 4486
  Gene Symbol: CYFIP1
  Gene Name: cytoplasmic FMR1 interacting protein 1
  ENST ID: ENST00000561263
  CDS Start-End: 1-531
cctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtggtatgtggatgaaaatctcgcaccatctatggaccttttgcaaaagcatactttctttgtgttataagttcttgtttctggcaatgtttttcatcctagtacgtaaggtgccaccaacagaaactttcttttcgttcccaaaatgaatctaaatataattggccagtaaagcagtctggcagagaaaa

SEQ ID NO: 124650 - DNA, 582 bp, Homo sapiens
  Payload ID: 4486
  Gene Symbol: CYFIP1
  Gene Name: cytoplasmic FMR1 interacting protein 1
  ENST ID: ENST00000611832
  CDS Start-End: 130-582
gtgtttcctggcgcattcccggccagcccgagtgactcactcggccaaggaaactcccagggcccgcccaggacccccaagccgccgcggacgcagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggac

SEQ ID NO: 124651 - DNA, 4515 bp, Homo sapiens
  Payload ID: 4486
  Gene Symbol: CYFIP1
  Gene Name: cytoplasmic FMR1 interacting protein 1
  Uniprot ID: Q7L576
  ENST ID: ENST00000610365
  CDS Start-End: 192-3953
agtgactcactcggccaaggaaactcccagggcccgcccaggacccccaagccgccgcggacgcagaatgtggctcagctgcccctggtcccatcccagggcagagctcctcctgagtacccttgagactggagcagattcagcagaaggcagattgccccctctccctggagctggctctgaagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatct

SEQ ID NO: 124652 - DNA, 553 bp, Homo sapiens
  Payload ID: 4486
  Gene Symbol: CYFIP1
  Gene Name: cytoplasmic FMR1 interacting protein 1
  ENST ID: ENST00000612288
  CDS Start-End: 1-553
ctacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtgaaacgctgcagcagtgctgtgacctttcgcagctgtggttccgagagttcttcctg

SEQ ID NO: 124653 - DNA, 544 bp, Homo sapiens
  Payload ID: 4486
  Gene Symbol: CYFIP1
  Gene Name: cytoplasmic FMR1 interacting protein 1
  ENST ID: ENST00000613006
  CDS Start-End: 62-544
agttttcctaaacacgcctgtgaccagctgactccactcagcgtttccgtgtgagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactg

SEQ ID NO: 124654 - DNA, 5674 bp, Homo sapiens
  Payload ID: 4486
  Gene Symbol: CYFIP1
  Gene Name: cytoplasmic FMR1 interacting protein 1
  Uniprot ID: Q7L576
  ENST ID: ENST00000617556
  CDS Start-End: 303-2771
ccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtc

SEQ ID NO: 124655 - DNA, 575 bp, Homo sapiens
  Payload ID: 4486
  Gene Symbol: CYFIP1
  Gene Name: cytoplasmic FMR1 interacting protein 1
  ENST ID: ENST00000619037
  CDS Start-End: 96-329
actcactcggccaaggaaactcccagggcccgcccaggacccccaagccgccgcggacgcagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgtgtaaaaacaatacatgctggttctgaaaattcaatgtctctggcccagagaaaacctttgtcagcgtttcaagggtgcacctgccctgttaatgctcattccctctccagatctgcacccacacacaccagaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggag

SEQ ID NO: 124656 - DNA, 6793 bp, Homo sapiens
  Payload ID: 4486
  Gene Symbol: CYFIP1
  Gene Name: cytoplasmic FMR1 interacting protein 1
  Uniprot ID: Q7L576
  ENST ID: ENST00000617928
  CDS Start-End: 56-3817
aggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtcattagtgcattcggcttttggagaagggatgaaaatgtaaaatacttctacaacaataaaatgttaatagaaa

SEQ ID NO: 124657 - DNA, 583 bp, Homo sapiens
  Payload ID: 4486
  Gene Symbol: CYFIP1
  Gene Name: cytoplasmic FMR1 interacting protein 1
  ENST ID: ENST00000622576
  CDS Start-End: 1-137
tgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcaccctctccctggggggacccaccctgagctgtgagcgggtggggctggtgaggcccgggttaaatgaggtcctcgctgcctgctcaggcagagaaagtggcgcctgtggtttctgctgctcctctgtttcccacccaactctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtgctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatt

SEQ ID NO: 124658 - DNA, 553 bp, Homo sapiens; identical to SEQ ID NO: 124652
  Payload ID: 4486
  Gene Symbol: CYFIP1
  Gene Name: cytoplasmic FMR1 interacting protein 1
  ENST ID: ENST00000626546
  CDS Start-End: 1-553

SEQ ID NO: 124659 - DNA, 2779 bp, Homo sapiens
  Payload ID: 4486
  Gene Symbol: CYFIP1
  Gene Name: cytoplasmic FMR1 interacting protein 1
  ENST ID: ENST00000628954
  CDS Start-End: 192-2779
agtgactcactcggccaaggaaactcccagggcccgcccaggacccccaagccgccgcggacgcagaatgtggctcagctgcccctggtcccatcccagggcagagctcctcctgagtacccttgagactggagcagattcagcagaaggcagattgccccctctccctggagctggctctgaagcccaggatggcggcccaggtgactctggaggacgcgctgtccaacgtggacctcctggaggagctgcccctgcctgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacagcttcgacgccatgttccgggaggccaaccacaacgtgtcagcgccctacgggaggatcaccctgcacgtcttctgggagctcaactatgacttcctgcccaactactgctacaacggctctaccaaccg

SEQ ID NO: 124660 - DNA, 2643 bp, Homo sapiens
  Payload ID: 4486
  Gene Symbol: CYFIP1
  Gene Name: cytoplasmic FMR1 interacting protein 1
  ENST ID: ENST00000625276
  CDS Start-End: 56-2643
aggaaactcccagggcccgcccaggacccccaagccgccgcggacgcagcccaggatggcggcccaggtgactctggaggacgcgctgtccaacgtggacctcctggaggagctgcccctgcctgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacagcttcgacgccatgttccgggaggccaaccacaacgtgtcagcgccctacgggaggatcaccctgcacgtcttctgggagctcaactatgacttcctgcccaactactgctacaacggctctaccaaccg

SEQ ID NO: 124661 - DNA, 575 bp, Homo sapiens
  Payload ID: 4486
  Gene Symbol: CYFIP1
  Gene Name: cytoplasmic FMR1 interacting protein 1
  ENST ID: ENST00000627816
  CDS Start-End: 96-329
actcactcggccaaggaaactcccagggcccgcccaggacccccaagccgccgcggacgcagaacaggggtccttatgtgttgttccagcccaggatggcggcccaggtgactctggaggacgcgctgtccaacgtggacctcctggaggagctgcccctgcctgaccagcagccctgcatcgagcccccgccatcctcgctgctctaccagccaaatttcaacactaactttgaagacagaaatgcatttgttactggcatcgcaagatacattgaacaagccaccgtccactctagcatgtataaaaacaatacatgctggttctgaaaattcaatgtctctggcccagagaaaacctttgtcagcgtttcaagggtgcgcctgccctgttaatgctcattccctctccagatctgcacccacacacaccagaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggag

SEQ ID NO: 124662 - DNA, 582 bp, Homo sapiens
  Payload ID: 4486
  Gene Symbol: CYFIP1
  Gene Name: cytoplasmic FMR1 interacting protein 1
  ENST ID: ENST00000627204
  CDS Start-End: 1-137
tgtgtgactgggagacggggcatgagcccttcaatgacccagccttgcggggcgagaaggaccccaagagcggcttcgacataaaagtaccacgccgcgccgtgggaccctccagcactcaggttctcgtcccttgagccccgcctgcacctctccctggggggacccaccctgagctgtgagcgggtggggctggtgaggcccgggttaaatgaggtcctcgctgcctgctcaggcagagaaagtggcgcctgtggtttctgctgctcctctgtttcccacccaactctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtgctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatt

SEQ ID NO: 124663 - DNA, 544 bp, Homo sapiens
  Payload ID: 4486
  Gene Symbol: CYFIP1
  Gene Name: cytoplasmic FMR1 interacting protein 1
  ENST ID: ENST00000628747
  CDS Start-End: 62-544
agttttcctaaacacgcctgtgaccagctgactccactcagcgtttccgtgtgagcccaggatggcggcccaggtgactctggaggacgcgctgtccaacgtggacctcctggaggagctgcccctgcctgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactg

SEQ ID NO: 124664 - DNA, 582 bp, Homo sapiens
  Payload ID: 4486
  Gene Symbol: CYFIP1
  Gene Name: cytoplasmic FMR1 interacting protein 1
  ENST ID: ENST00000630158
  CDS Start-End: 130-582
gtgtttcctggcgcattcccggccagcccgagtgactcactcggccaaggaaactcccagggcccgcccaggacccccaagccgccgcggacgcagaacaggggtccttatgtgttgttccagcccaggatggcggcccaggtgactctggaggacgcgctgtccaacgtggacctcctggaggagctgcccctgcctgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggac

SEQ ID NO: 124665 - DNA, 3673 bp, Homo sapiens
  Payload ID: 4487
  Gene Symbol: CYFIP2
  Gene Name: cytoplasmic FMR1 interacting protein 2
  ENST ID: ENST00000435847
  CDS Start-End: 97-3450
agagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaa

SEQ ID NO: 124666 - DNA, 3477 bp, Homo sapiens
  Payload ID: 4487
  Gene Symbol: CYFIP2
  Gene Name: cytoplasmic FMR1 interacting protein 2
  ENST ID: ENST00000522463
  CDS Start-End: 97-3270
agagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatg

SEQ ID NO: 124667 - DNA, 580 bp, Homo sapiens
  Payload ID: 4487
  Gene Symbol: CYFIP2
  Gene Name: cytoplasmic FMR1 interacting protein 2
  ENST ID: ENST00000522637
  CDS Start-End: 92-298
atcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatg

SEQ ID NO: 124668 - DNA, 6370 bp, Homo sapiens
  Payload ID: 4487
  Gene Symbol: CYFIP2
  Gene Name: cytoplasmic FMR1 interacting protein 2
  ENST ID: ENST00000521420
  CDS Start-End: 92-3775
atcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccag

SEQ ID NO: 124669 - DNA, 925 bp, Homo sapiens
  Payload ID: 4487
  Gene Symbol: CYFIP2
  Gene Name: cytoplasmic FMR1 interacting protein 2
  ENST ID: ENST00000611925
  CDS Start-End: 260-925
gaggggcgcagcgtcgatgtttgggggcggagggctttgatgagagaggagcaggtctgacccgcttggaagctttctggcctacactagcatcgctcaccaagctggctgcgggcacggtggaagtgggggaaggggatgagtgggctgactcctgggggaaaaggtggtttttttcttgagctctgaagaaccaggaagatgcttgcctgtctgttgtggcgtctacttttcagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccag

SEQ ID NO: 124670 - DNA, 915 bp, Homo sapiens
  Payload ID: 4487
  Gene Symbol: CYFIP2
  Gene Name: cytoplasmic FMR1 interacting protein 2
  ENST ID: ENST00000621516
  CDS Start-End: 139-354
agtctcgcttcgtcacccaggctggagtacagtggctcaatctcagctcactgcaacctccacctcccaggttcaagcaattctgcctcaccctcccgagtagctgggactacagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgatattttagatgcattgtctcatttgctcctgacatcaaccctgtgagaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaac

SEQ ID NO: 124671 - DNA, 1000 bp, Homo sapiens
  Payload ID: 4487
  Gene Symbol: CYFIP2
  Gene Name: cytoplasmic FMR1 interacting protein 2
  ENST ID: ENST00000611075
  CDS Start-End: 435-1000
cctggacccgccgcagagccaggtaagcggccctcgcaggcctcgggccgggcacggggactaggatgccgccggggacggggatgaggccgtgaggatgcgcgaagggccgccccctctcccggcccgcggggggcgctcggcgctgtgcccgggctagcccgaggcccggcctcaggccccacgcggcccctttccccctcggacccaccgtgcgtcccgcggcacggaccctctgcccgggaggcgcgggcacatcgcggagctccggcgcggcggcgggggagccgcagcagcaggtgcgcggcctgggccggagccgccagcccgggaggaggcggtgctaatctcagggaccggagacacctgcagcggccgcgagcccggcagcggcgacatcctcgagtccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaa

SEQ ID NO: 124672 - DNA, 4210 bp, Homo sapiens
  Payload ID: 4487
  Gene Symbol: CYFIP2
  Gene Name: cytoplasmic FMR1 interacting protein 2
  Uniprot ID: Q96F07
  ENST ID: ENST00000616178
  CDS Start-End: 141-3977
agcggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagg

SEQ ID NO: 124673 - DNA, 4124 bp, Homo sapiens
  Payload ID: 4487
  Gene Symbol: CYFIP2
  Gene Name: cytoplasmic FMR1 interacting protein 2
  Uniprot ID: Q96F07
  ENST ID: ENST00000620254
  CDS Start-End: 139-3900
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaa

SEQ ID NO: 124674 - DNA, 967 bp, Homo sapiens
  Payload ID: 4487
  Gene Symbol: CYFIP2
  Gene Name: cytoplasmic FMR1 interacting protein 2
  ENST ID: ENST00000617629
  CDS Start-End: 81-967
cggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaa

SEQ ID NO: 124675 - DNA, 576 bp, Homo sapiens
  Payload ID: 4487
  Gene Symbol: CYFIP2
  Gene Name: cytoplasmic FMR1 interacting protein 2
  ENST ID: ENST00000520960
  CDS Start-End: 1-306
ctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgacggagtcttgctctgttgcccaggttggagtgcagtggcactatctcagctcaccgcaacctccgcttcccaggttcaggctggagtgcagtcgtgtgatctcagctcaccgcaacctctgccacccagaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggc

SEQ ID NO: 124676 - DNA, 2988 bp, Homo sapiens
  Payload ID: 4487
  Gene Symbol: CYFIP2
  Gene Name: cytoplasmic FMR1 interacting protein 2
  ENST ID: ENST00000620969
  CDS Start-End: 2284-2988
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggaattagagtggacaaaggttactataaggataaagagacccctaaactgcccacatggctttttaagccttttccatgctttgctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgcctcctttcacccaagaaccacaacgagacaaacctgccaacgtccagccttattacctctatggatccaagcctctcaacattgcctacagccacatctacagctcctacaggaatttcgtggggccacctcatttcaagactatgcagactcctgggttatcagggcatcgctgtggtcatggaggaactgctaa

SEQ ID NO: 124677 - DNA, 4256 bp, Homo sapiens
  Payload ID: 4487
  Gene Symbol: CYFIP2
  Gene Name: cytoplasmic FMR1 interacting protein 2
  Uniprot ID: Q96F07
  ENST ID: ENST00000618329
  CDS Start-End: 266-4027
gtagagttaaggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattccccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaa

SEQ ID NO: 124678 - DNA, 8092 bp, Homo sapiens
  Payload ID: 4488
  Gene Symbol: CLASP1
  Gene Name: cytoplasmic linker associated protein 1
  Uniprot ID: Q7Z460
  ENST ID: ENST00000263710
  CDS Start-End: 391-5007
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattcaa

SEQ ID NO: 124679 - DNA, 7915 bp, Homo sapiens
  Payload ID: 4488
  Gene Symbol: CLASP1
  Gene Name: cytoplasmic linker associated protein 1
  Uniprot ID: Q7Z460
  ENST ID: ENST00000397587
  CDS Start-End: 391-4830
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagatggtactaccactaaagcggagggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattcaa

SEQ ID NO: 124680 - DNA, 8002 bp, Homo sapiens
  Payload ID: 4488
  Gene Symbol: CLASP1
  Gene Name: cytoplasmic linker associated protein 1
  Uniprot ID: Q7Z460
  ENST ID: ENST00000409078
  CDS Start-End: 502-4917
gctctctatggtgtacccgggttggtggcggtaagaagaaaaagggtgaccgcactgcgcaggcgccctcggcgtctctctcgctctctcggtcttttttttttttttctttttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattcaa

SEQ ID NO: 124681 - DNA, 5660 bp, Homo sapiens
  Payload ID: 4488
  Gene Symbol: CLASP1
  Gene Name: cytoplasmic linker associated protein 1
  ENST ID: ENST00000455322
  CDS Start-End: 353-4789
cattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagatggtactaccactaaagcggagggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaaggttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctg

SEQ ID NO: 124682 - DNA, 663 bp, Homo sapiens
  Payload ID: 4488
  Gene Symbol: CLASP1
  Gene Name: cytoplasmic linker associated protein 1
  ENST ID: ENST00000418989
  CDS Start-End: 214-663
agtgagggcatgccctggcaaccggtgtcatgatattatttatgagtttgtcaagccattggagatctttgttacttttaaaaagggaagataatggaaacatcataagaaacacaatcatgtaaggcatctttccagttctttagtaactgctggatttgaaagttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcgg

SEQ ID NO: 124683 - DNA, 3966 bp, Homo sapiens
  Payload ID: 4488
  Gene Symbol: CLASP1
  Gene Name: cytoplasmic linker associated protein 1
  ENST ID: ENST00000452274
  CDS Start-End: 1-3827
ttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagattgctgattcagaagcagaatgtgaggataaagaaggaaatttgtttccatcagaagtctcttgtacaagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtccctt

SEQ ID NO: 124684 - DNA, 555 bp, Homo sapiens
  Payload ID: 4488
  Gene Symbol: CLASP1
  Gene Name: cytoplasmic linker associated protein 1
  ENST ID: ENST00000449975
  CDS Start-End: 225-555
aaagtgctgggattacagtaatgagccaccatgcccggctcaagaaagcctcttttttcttaactttttctactaattatgattgcattctcccaccttttcctttcatttttggtgtcactaggatggaatatttagactggttaaggaattttgctttaatttaaatgccaaggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagag

SEQ ID NO: 124685 - DNA, 7909 bp, Homo sapiens
  Payload ID: 4488
  Gene Symbol: CLASP1
  Gene Name: cytoplasmic linker associated protein 1
  Uniprot ID: Q7Z460
  ENST ID: ENST00000541377
  CDS Start-End: 391-4824
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagagtccagacacatgagggaagacatggagtacataggcctggactcaggtcggatccgcacaagacggcaaagctctgggagtgccaccaacgtcgcctctacacctgataaccggggccgcagtcgcgctaaagtggtttcacagtcccagcctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattcaa

SEQ ID NO: 124686 - DNA, 1597 bp, Homo sapiens
  Payload ID: 4489
  Gene Symbol: CLASP2
  Gene Name: cytoplasmic linker associated protein 2
  Uniprot ID: O75122
  ENST ID: ENST00000313350
  CDS Start-End: 178-1473
acagcacctagggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttt

SEQ ID NO: 124687 - DNA, 1989 bp, Homo sapiens
  Payload ID: 4489
  Gene Symbol: CLASP2
  Gene Name: cytoplasmic linker associated protein 2
  ENST ID: ENST00000333778
  CDS Start-End: 227-1603
gcagaatctgggtataaggaataaggcagggcgtgctagaagatacactatgggaggagctggcagaaaatgcagagtagcaaaaacatgaaaaatacttttactacctttagagttaaaatgttttatgttttgacttaatatgtataagtaagaagtatgaaaatactgcattttgattttgaattacagaggattattttatatggtgttagccaatatataaatgcttattcaaaggacctttatttcgtattatatatcttaccaaaataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggtaagagaactgattatggaaaattgtaccatgttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgt

SEQ ID NO: 124688 - DNA, 7141 bp, Homo sapiens
  Payload ID: 4489
  Gene Symbol: CLASP2
  Gene Name: cytoplasmic linker associated protein 2
  Uniprot ID: O75122
  ENST ID: ENST00000359576
  CDS Start-End: 212-4759
gggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgt

SEQ ID NO: 124689 - DNA, 7282 bp, Homo sapiens
  Payload ID: 4489
  Gene Symbol: CLASP2
  Gene Name: cytoplasmic linker associated protein 2
  ENST ID: ENST00000399362
  CDS Start-End: 355-4896
agaggtcctatcgctcccagcggtttccgcagccacctccaccacctccgcagcaaaacgctagccggactggagggccctcgccggcgtcgtgctgacgtcacgcgcgtgctgacgtcgcccgcggccgcggcctctgaagcgggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaa

SEQ ID NO: 124690 - DNA, 614 bp, Homo sapiens
  Payload ID: 4489
  Gene Symbol: CLASP2
  Gene Name: cytoplasmic linker associated protein 2
  ENST ID: ENST00000480385
  CDS Start-End: 1-614
aaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaagacagtcaagccagcacttcgggaccagcttcactctttttggagctccaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacag

SEQ ID NO: 124691 - DNA, 5972 bp, Homo sapiens
  Payload ID: 4489
  Gene Symbol: CLASP2
  Gene Name: cytoplasmic linker associated protein 2
  ENST ID: ENST00000480013
  CDS Start-End: 453-4334
attgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtt

SEQ ID NO: 124692 - DNA, 536 bp, Homo sapiens
  Payload ID: 4489
  Gene Symbol: CLASP2
  Gene Name: cytoplasmic linker associated protein 2
  ENST ID: ENST00000475576
  CDS Start-End: 1-536
cggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtc

SEQ ID NO: 124693 - DNA, 685 bp, Homo sapiens
  Payload ID: 4489
  Gene Symbol: CLASP2
  Gene Name: cytoplasmic linker associated protein 2
  ENST ID: ENST00000496954
  CDS Start-End: 152-685
attgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagcc

SEQ ID NO: 124694 - DNA, 1097 bp, Homo sapiens
  Payload ID: 4489
  Gene Symbol: CLASP2
  Gene Name: cytoplasmic linker associated protein 2
  ENST ID: ENST00000476251
  CDS Start-End: 1-554
ctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtagatacccaatagtgggattgctggatcaaatggagttctacttttagttctgtaaggactgtatttctaagagaaagcaactgagcaatagcattaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagata

SEQ ID NO: 124695 - DNA, 1940 bp, Homo sapiens
  Payload ID: 4489
  Gene Symbol: CLASP2
  Gene Name: cytoplasmic linker associated protein 2
  ENST ID: ENST00000487200
  CDS Start-End: 189-1553
gattggctgttacagcacctagggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactaggtaagagaactgattatggaaaattgtaccatgttctctccctgatctctgtgaagacaagttcatataccttaatcatttctattcattcttgttatttaaggatagtccatatgttttaatataattctatattgcggacacacttctgaggaatctgagctgccttgtttctccttttcccttgttctcatcatcgtcttgatcaaagaaacaattcttgaatccatgattgcctgtagaattttcataactgcacttctaccacatctagccactggtttctaagggggtttgggaagggaattggcttgtatctaactttcctgttttctttctcctacttctcttctcttaccaagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgta

SEQ ID NO: 124696 - DNA, 874 bp, Homo sapiens
  Payload ID: 4489
  Gene Symbol: CLASP2
  Gene Name: cytoplasmic linker associated protein 2
  ENST ID: ENST00000485378
  CDS Start-End: 176-874
agcacctagggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttccc

SEQ ID NO: 124697 - DNA, 4814 bp, Homo sapiens
  Payload ID: 4489
  Gene Symbol: CLASP2
  Gene Name: cytoplasmic linker associated protein 2
  ENST ID: ENST00000461133
  CDS Start-End: 117-3938
acagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaa

SEQ ID NO: 124698 - DNA, 6978 bp, Homo sapiens
  Payload ID: 4489
  Gene Symbol: CLASP2
  Gene Name: cytoplasmic linker associated protein 2
  ENST ID: ENST00000468888
  CDS Start-End: 48-4592
gaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaa

SEQ ID NO: 124699 - DNA, 825 bp, Homo sapiens
  Payload ID: 4489
  Gene Symbol: CLASP2
  Gene Name: cytoplasmic linker associated protein 2
  ENST ID: ENST00000487553
  CDS Start-End: 1-661
ttcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatc

SEQ ID NO: 124700 - DNA, 4176 bp, Homo sapiens
  Payload ID: 4489
  Gene Symbol: CLASP2
  Gene Name: cytoplasmic linker associated protein 2
  ENST ID: ENST00000635664
  CDS Start-End: 144-4058
ccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcgttcatcatcacctgacaaaaatgaaggatcacaatctgctaataccattggtgctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttag

SEQ ID NO: 124701 - DNA, 554 bp, Homo sapiens
  Payload ID: 4490
  Gene Symbol: CPEB1
  Gene Name: cytoplasmic polyadenylation element binding protein 1
  ENST ID: ENST00000568994
  CDS Start-End: 213-554
acacgagcaggcagtcggctgctttggctctgctgtcggcggagaggacttcagtcgtgcgtgagggctgcttggccaccattgctggagaccggagggcgctgccttgcaacccagacttaacggcactgcaccgggactattccaagtagctgttgtgctgtctttccctgggagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagt

SEQ ID NO: 124702 - DNA, 527 bp, Homo sapiens
  Payload ID: 4490
  Gene Symbol: CPEB1
  Gene Name: cytoplasmic polyadenylation element binding protein 1
  ENST ID: ENST00000569257
  CDS Start-End: 421-527
atgggcgggagagggttaggcttgcaggccgcggaggtggcgtaggcggggagcgacccgagcccactctgggctgtgctgttcggaccctcagcctggcgagcattcgtgatgagttcccctgaggtaacaggagaatccccagagggcaggtctaaagcattgccaagtaattcttcctgttgactcctgattttcggtagtattaaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctg

SEQ ID NO: 124703 - DNA, 557 bp, Homo sapiens
  Payload ID: 4490
  Gene Symbol: CPEB1
  Gene Name: cytoplasmic polyadenylation element binding protein 1
  ENST ID: ENST00000567678
  CDS Start-End: 506-557
ctttctcacactgccgtcgcacgggagacccgaagccgctggcgctggaagctcacgccccctgcgggtctctttagcacccggcgcgcggtgggggcgcccgggcgggacggggcggggctgctgacggcgtagaccccgtgctctgtggagagccccacgacggcggcggtcgcggcacctttaaggtggagggctcaagcccctcgtgcggcttcccaatcctgggcaggtcacgtggcttcacaccttcgcttggcgccggagagggagtctcgggggcggggctggccaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaa

SEQ ID NO: 124704 - DNA, 2068 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000617462
  CDS Start-End: 313-1773
actggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgg

SEQ ID NO: 124705 - DNA, 2112 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000615198
  CDS Start-End: 108-1793
cggggctgcgcgcggcccgctgcaaaaatagtgcccacgtgcgtgcgcgtctctcgcccgccggctggccggtcagcccgtcagccccgcagggccacaccggccccatggcgttcccgctggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaa

SEQ ID NO: 124706 - DNA, 3074 bp, Homo sapiens
  Payload ID: 4490
  Gene Symbol: CPEB1
  Gene Name: cytoplasmic polyadenylation element binding protein 1
  ENST ID: ENST00000610719
  CDS Start-End: 1-1686
atggcattgtcactggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 124707 - DNA, 2068 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000620212
  CDS Start-End: 313-1773
actggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgg

SEQ ID NO: 124708 - DNA, 2776 bp, Homo sapiens
  Payload ID: 4490
  Gene Symbol: CPEB1
  Gene Name: cytoplasmic polyadenylation element binding protein 1
  ENST ID: ENST00000617958
  CDS Start-End: 138-2018
taatgtcaatatgttttctggcattgctacttcaacatcgtcttccatgtctggcactggtttggagcactcatctctatcagattgtcttctgctaattcctctggtatgttaactcttggatttctccaaggtccatgtcttggaaatcttcactcccaacctttttttgtcatatctacagtttctttcatgatttcctgtattggctctgtggtaaatctgtgaagtcatgtacaacatctggaaacagtttttttaagcaggaatttattattttgggcatgatggctttcatggatttttctgtaacaatgatggcattgtcactggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaa

SEQ ID NO: 124709 - DNA, 1559 bp, Homo sapiens
  Payload ID: 4490
  Gene Symbol: CPEB1
  Gene Name: cytoplasmic polyadenylation element binding protein 1
  ENST ID: ENST00000614977
  CDS Start-End: 187-603
ctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctg

SEQ ID NO: 124710 - DNA, 2009 bp, Homo sapiens
  Payload ID: 4490
  Gene Symbol: CPEB1
  Gene Name: cytoplasmic polyadenylation element binding protein 1
  ENST ID: ENST00000616959
  CDS Start-End: 18-1712
attttcccttctaggctatgcctgagtgcctgtggacacagggtgtactgcaggaagttctgaacagctatttctgtggcagcattattctctcgaccctgccatgggaggtcccaggtgggcatgcttcccgtatctgcttgcttctccttgcaacaggggagaacaagcaggtggagtgctaccagctgagtccaggtttgagcagcctgcctgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgggg

SEQ ID NO: 124711 - DNA, 2220 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000617522
  CDS Start-End: 526-1986
tctgtggagagccccacgacggcggcggtcgcggcacctttaaggtggagggctcaagcccctcgtgcggcttcccaatcctgggcaggtcacgtggcttcacaccttcgcttggcgccggagagggagtctcgggggcggggctggccaggtagtgtggcgcgagggcggaagactggcggggcttcgtgcccgggagacccgccgggctggcggcattgaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagatgcagtcgtgattggcactgtaaagggtctccaatttgatgtactgtttaaggaacttctgcagaccccaatttgaacagtgtagtgtcagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttac

SEQ ID NO: 124712 - DNA, 4882 bp, Homo sapiens
  Payload ID: 4490
  Gene Symbol: CPEB1
  Gene Name: cytoplasmic polyadenylation element binding protein 1
  ENST ID: ENST00000614918
  CDS Start-End: 1727-3493
gtgggaggagcacttgagcccaggagtttcaagttcagcctgggcaacacagcgagacctcctctctgcaggttataaatctttgcatcttagccttcatgaagttgccttcctgaaattgagaatcagcttagaaatctacagttgtgaaaagggccttgtgtgtcactggatttaacagttctcaatggcaccactctagagagcttgggaaaacaaccttgtaggattgtgtattttggtcgtcttcacagtttgcagagggtaccaatcttcaagaacttgaggctgacgtgaggctcaagtttgtccctttaaggtcatcctgcagagttggtaaaactgtaaatgctcttggtcattctcatgctcacttggattttagtaggccaaacaaaatgacattgggcctcttcttgttttgttttgatgtgaccagcttatgagatattaagtgccagtttcattacttggtctgtttttgttttccgcaagataattgaggataatagaactgatgaggcaggctccccttaaaaaactcaatctgtcaaccaatatttcattgcttcttatgttgggcattggctgtggagagtgagggagaccggagtgaagaatggtacctacatttctgctttgggcatctggtggatggtggtgttatttaccgagatagggaataccaaaagaatagtttttgtgtaagggttcatgattttttatatatatatataggagttcttttttcattcggtaatgtcttacccatcttctcatgccagttaataaagttgtatgtactaataatgaccacatagagttgtataacttaatcagtttgggtggttttaccactgttggtacttacctctcttgtattcaataattagtgtttgcagatacaaattagcagctactgtatgccatgcaaaatgctttacatatgtcatcaaaaagttggtatcctttttccatttcacaaatggggaaactgagggatagaggttaagtaactgtgatatcacacagccaataaatggcagaatgaaaatttttaaacagctgtattgacataaaatctacataccctaaagttcacctttaatgtacagttcattggtttttagtccagttgactcttggacagtgtgggagttaggaggaccaacccccacagtcaaatatctatgtataactttgactcccccaaaacttgactaatagcctgctgttgaccggaagccttaccgataacataaacagttgatcacatgttttgtatgttacatgtattttataccgtattcttacgataaagtaggctagagaaaaaatgttactagaaaatcataagagaaaatatatttactgttcattaagtggaagtgaatcataaagatcttcatatttactgttttcacattgagcaggccgaggaagaggaaggattgattggtcttgctctctcaggggtggcaaaggtggaaggatgtggagcggatgtaaggagaagcaggcacagtcagtgtaactttacagaaataatttctgtctgactttttgctttttcatttctgtaaaaatgtttctatgtggtaccaatcctaattccaccatttgcgttagtttcagtgcctgtgtaatagaagggtctgtattgtaaaagaagtcaaaagcagccttgaataatcggaacccttttgccagatcatctaatgtcaatatgttttctggcattgctacttcaacatcgtcttccatgtctggcactggtttggagcactcatctctatcagattgtcttctgctaattcctctggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagca

SEQ ID NO: 124713 - DNA, 2459 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000616775
  CDS Start-End: 226-1701
agccggctgatgtcactggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaa

SEQ ID NO: 124714 - DNA, 1919 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000619696
  CDS Start-End: 162-1622
aatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgggg

SEQ ID NO: 124715 - DNA, 2459 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000618449
  CDS Start-End: 226-1701
agccggctgatgtcactggcagcgggaagcatcagcagcctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaa

SEQ ID NO: 124716 - DNA, 1919 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000611163
  CDS Start-End: 162-1622
aatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgggg

SEQ ID NO: 124717 - DNA, 3074 bp, Homo sapiens
  Payload ID: 4490
  Gene Symbol: CPEB1
  Gene Name: cytoplasmic polyadenylation element binding protein 1
  ENST ID: ENST00000611031
  CDS Start-End: 1-1686
atggcattgtcactggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggtggggttgatagaagtttttaatcacaaagtcacaggacttttttcttttgtaactgagctaaaaagggctgcttttcggtgggggcagatgaaggctcacaggagccctttctcttagagggggcaagtacccttcccttatatctttaatttgaggaatgtatgagataacagttgcagttgactgaaatgccactggaatttgaaaacttgacttttttttctttcctttttttttttttttttttttttaaaaagaaacaaaaaacccacaaaaactacttgcccctcctagggaagctgtgtgccaaagaaccagtgtcataacccctccctcctgctgagctgacgttgcattgttgcatatcccagctactctgtgggttttgtgaagctgtgtgtgaagtctctacctcattgtagtatatgcaggcaagactgcactctcctacagatgtgtggagtaagctgtggtgtagtttttttggcacataataaacacgttgcagc

SEQ ID NO: 124718 - DNA, 2422 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000620182
  CDS Start-End: 680-2140
cggtggggcctccgagccgcactgcggcctccaggcggcctcgagcgtctgtccagacgggagctgaccggacataaaggagcaccggcgcccggaacgtttctttctcacactgccgtcgcacgggagacccgaagccgctggcgctggaagctcacgccccctgcgggtctctttagcacccggcgcgcggtgggggcgcccgggcgggacggggcggggctgctgacggcgtagaccccgtgctctgtggagagccccacgacggcggcggtcgcggcacctttaaggtggagggctcaagcccctcgtgcggcttcccaatcctgggcaggtcacgtggcttcacaccttcgcttggcgccggagagggagtctcgggggcggggctggccaggtagtgtggcgcgagggcggaagactggcggggcttcgtgcccgggagacccgccgggctggcggcattgaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccatcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgc

SEQ ID NO: 124719 - DNA, 1997 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000632526
  CDS Start-End: 303-1763
gaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagatgcagtcgtgattggcactgtaaagggtctccaatttgatgtactgtttaaggaacttctgcagaccccaatttgaacagtgtagtgtcagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttac

SEQ ID NO: 124720 - DNA, 262 bp, Homo sapiens
  Payload ID: 4490
  Gene Symbol: CPEB1
  Gene Name: cytoplasmic polyadenylation element binding protein 1
  ENST ID: ENST00000631406
  CDS Start-End: 211-262
gaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaa

SEQ ID NO: 124721 - DNA, 2776 bp, Homo sapiens
  Payload ID: 4490
  Gene Symbol: CPEB1
  Gene Name: cytoplasmic polyadenylation element binding protein 1
  ENST ID: ENST00000632172
  CDS Start-End: 138-2018
taatgtcaatatgttttctggcattgctacttcaacatcgtcttccatgtctggcactggtttggagcactcatctctatcagattgtcttctgctaattcctctggtatgttaactcttggatttctccaaggtccatgtcttggaaatcttcactcccaacctttttttgtcatatctacagtttctttcatgatttcctgtattggctctgtggtaaatctgtgaagtcatgtacaacatctggaaacagtttttttaagcaggaatttattattttgggcatgatggctttcatggatttttctgtaacaatgatggcattgtcactggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaactacgtgtccagaaggtattgaggtattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttaaaccaaaatcatatttcatattttacgctcgagggtttttaccggttcctttttacactccttaaaacagtttttaagtcgtttggaacaagatattttttctttcctggcagcttttaacattatagcaaatttgtgtctgggggactgctggtcactgtttctcacagttgcaaatcaaggcatttgcaaccaa

SEQ ID NO: 124722 - DNA, 1559 bp, Homo sapiens
  Payload ID: 4490
  Gene Symbol: CPEB1
  Gene Name: cytoplasmic polyadenylation element binding protein 1
  ENST ID: ENST00000632883
  CDS Start-End: 187-603
ctgatcacatgctggcccagtctgtaatgcagacgggataggggtgtgtgtgtgaggggagggggcctgtatggcaactgctcttgccccagcgtccccaaaagtgcagaggcagcggctgcagcatccagccagcttggatgtctggcctacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctg

SEQ ID NO: 124723 - DNA, 1953 bp, Homo sapiens
  Payload ID: 4490
  Gene Symbol: CPEB1
  Gene Name: cytoplasmic polyadenylation element binding protein 1
  Uniprot ID: Q9BZB8
  ENST ID: ENST00000631674
  CDS Start-End: 211-1671
gaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgc

SEQ ID NO: 124724 - DNA, 1990 bp, Homo sapiens
  Payload ID: 4490
  Gene Symbol: CPEB1
  Gene Name: cytoplasmic polyadenylation element binding protein 1
  ENST ID: ENST00000632305
  CDS Start-End: 1-1671
gaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcggggaaaaaaaaaaaaaaaaaaaaaa

SEQ ID NO: 124725 - DNA, 425 bp, Homo sapiens
  Payload ID: 4490
  Gene Symbol: CPEB1
  Gene Name: cytoplasmic polyadenylation element binding protein 1
  ENST ID: ENST00000633271
  CDS Start-End: 319-425
gcattcgtgatgagttcccctgaggtaacaggagaatccccagagggcaggtctaaagcattgccaagtaattcttcctgttgactcctgattttcggtagtattaaggaagaagaagcaggaaggataaaagattgctgggacaaccaggaagcacctgctctctccacgtgtagtaatgccaatatctttcgaaggataaatgccatattggataattctctggatttcagtagagtctgcactacacctataaaccgaggaattcatgatcatttgccagacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctg

SEQ ID NO: 124726 - DNA, 554 bp, Homo sapiens; identical to SEQ ID NO: 124701
  Payload ID: 4490
  Gene Symbol: CPEB1
  Gene Name: cytoplasmic polyadenylation element binding protein 1
  ENST ID: ENST00000634018
  CDS Start-End: 213-554

SEQ ID NO: 124727 - DNA, 2009 bp, Homo sapiens
  Payload ID: 4490
  Gene Symbol: CPEB1
  Gene Name: cytoplasmic polyadenylation element binding protein 1
  ENST ID: ENST00000633293
  CDS Start-End: 18-1712
attttcccttctaggctatgcctgagtgcctgtggacacagggtgtactgcaggaagttctgaacagctatttctgtggcagcattattctctcgaccctgccatgggaggtcccaggtgggcatgcttcccgtatctgcttgcttctccttgcaacaggggagaacaagcaggtggagtgctaccagctgagtccaggtttgagcagcctgcctgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctagaggagctggccttgcccagtggcctgtggcgcccaaagctggcaggtcaggcaagcagcctgcaccaccctgccactggcgaccagggagctggcttcccaaggacaagggaaaattgtagtcacctttgcacttgctgaatctgtctttgtttctgcactaattaatgcacattgagttttgtcaggttttgttttcagggggtgtaccaagggcaaggaccctctggcttaccctccaagcgactctgtagttttcccagattttagttcctcattttgcagatgaaaagcgggg

SEQ ID NO: 124728 - DNA, 5612 bp, Homo sapiens; identical to SEQ ID NO: 122574
  Payload ID: 4491
  Gene Symbol: CPEB2
  Gene Name: cytoplasmic polyadenylation element binding protein 2
  ENST ID: ENST00000259997
  CDS Start-End: 50-1843

SEQ ID NO: 124729 - DNA, 2013 bp, Homo sapiens; identical to SEQ ID NO: 122569
  Payload ID: 4491
  Gene Symbol: CPEB2
  Gene Name: cytoplasmic polyadenylation element binding protein 2
  Uniprot ID: Q7Z5Q1
  ENST ID: ENST00000345451
  CDS Start-End: 88-1767

SEQ ID NO: 124730 - DNA, 5524 bp, Homo sapiens; identical to SEQ ID NO: 122572
  Payload ID: 4491
  Gene Symbol: CPEB2
  Gene Name: cytoplasmic polyadenylation element binding protein 2
  Uniprot ID: Q7Z5Q1
  ENST ID: ENST00000382395
  CDS Start-End: 50-1753

SEQ ID NO: 124731 - DNA, 5509 bp, Homo sapiens; identical to SEQ ID NO: 122571
  Payload ID: 4491
  Gene Symbol: CPEB2
  Gene Name: cytoplasmic polyadenylation element binding protein 2
  Uniprot ID: Q7Z5Q1
  ENST ID: ENST00000382401
  CDS Start-End: 50-1738

SEQ ID NO: 124732 - DNA, 6797 bp, Homo sapiens; identical to SEQ ID NO: 122570
  Payload ID: 4491
  Gene Symbol: CPEB2
  Gene Name: cytoplasmic polyadenylation element binding protein 2
  Uniprot ID: Q7Z5Q1
  ENST ID: ENST00000442003
  CDS Start-End: 1-3024

SEQ ID NO: 124733 - DNA, 635 bp, Homo sapiens; identical to SEQ ID NO: 122568
  Payload ID: 4491
  Gene Symbol: CPEB2
  Gene Name: cytoplasmic polyadenylation element binding protein 2
  ENST ID: ENST00000509684
  CDS Start-End: 1-504

SEQ ID NO: 124734 - DNA, 2103 bp, Homo sapiens; identical to SEQ ID NO: 122567
  Payload ID: 4491
  Gene Symbol: CPEB2
  Gene Name: cytoplasmic polyadenylation element binding protein 2
  Uniprot ID: Q7Z5Q1
  ENST ID: ENST00000507071
  CDS Start-End: 88-1857

SEQ ID NO: 124735 - DNA, 6878 bp, Homo sapiens; identical to SEQ ID NO: 122573
  Payload ID: 4491
  Gene Symbol: CPEB2
  Gene Name: cytoplasmic polyadenylation element binding protein 2
  Uniprot ID: Q7Z5Q1
  ENST ID: ENST00000538197
  CDS Start-End: 1-3105

SEQ ID NO: 124736 - DNA, 4851 bp, Homo sapiens
  Payload ID: 4492
  Gene Symbol: CPEB3
  Gene Name: cytoplasmic polyadenylation element binding protein 3
  Uniprot ID: Q8NE35
  ENST ID: ENST00000265997
  CDS Start-End: 174-2270
gtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggtaaacactaccctcccagtggcccaccaatgagtttcgctgatataatgtggaggaatcattttgcaggacgcatggggataaatttccatcatccaggaacagataatattatggcacttaacaatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaa

SEQ ID NO: 124737 - DNA, 7664 bp, Homo sapiens
  Payload ID: 4492
  Gene Symbol: CPEB3
  Gene Name: cytoplasmic polyadenylation element binding protein 3
  Uniprot ID: Q8NE35
  ENST ID: ENST00000412050
  CDS Start-End: 90-2144
cataatcaacctgaaagaagaaaataaatactgtatacttttaaattttatcgattcttaaaaactggacactcaaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggacgcatggggataaatttccatcatccaggaacagataatattatggcacttaacagtcgatcttctctctttccctttgaagatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagcagaacatgtgagattttgagaagccttttcctttatcacagtggtttagtgtaagactagggatgtcacagtgcagttctctagggatgtcacggtggatttatacaacaccaggtgcagccaaacctgtggccctgagaatgaagtcacccaaccgaagtaccactgggtttaaaatctggctaagtcaacagaatgtttcattgctttttcccctctaactcgtcattatgtcgtgtgtgtgtgtgtgtgtgtgagagagagagagagagagagagagaaaaactgccaccaactgctgtccttgtgtgagacagtgcctttctcccaggccgaatcttttatgtgcactgacagtggtgatatcggagtcatacaggaagttgctaagaggacacggctttcgtggtgtactgcagacctcacctgcagggtctcactcatgctgcctccctgtaaggctcagttggtggcactgaggaagcacactcggatgtcaccactgtctgtggaccctgactatgtgtcgggttgcatcttcctccacacccatgcctgcttcctgttctggtgccccttgcctttcattgtggcaactgcgtgcatgatctgtctgcctttctgctgctgcttttccaacaccctcctcacctggaagctgggcagttaaggcacagtcattaatgtgtcattgcaatagcacctacagtcaaagcaaaaactacaactgcaaaactggtgttgcgtaaacagaacagccaatgacttgatccagatagatgatatgtttctactagtggttgatggcctctttcagctccatcgctatggaggcgaggttcatcaataactcagagaaacttgtgtccagagttggtcttgggtatgctctatgtattcagttttgtaaataatatatagattagatcaagttgtgatgtaaaattttaactcaaattgggtactactggttggaattttacattaactacaaataaatgattaggaacagaagaaaagtggaaaattcttgcttagtggtataaagattatgcttagatttctgcctatatcttgtgttttatagcttgttagtgaggcatgggctaatgcagaatgtactgcatttatgcaattagcaaataactgctagttttcattttatctattatattagcaacaaaaatggcatttaactgggtaaagctcctacctaaatatttgagtattgtgacatctctacttgcaaggtttgagtgaaagattagtcacagattagtgaaaaaaatgtatctttttgttaaaactggcttatttgaatggattgttgcttttcactagcttgtatggtatgtcagctaacatttgtttttttttttcttttataataaccaaacttctctatctcagctgcaatagtgttccatcttaccacagagtgttttataattaatgctgttgactttataccccaaaatgggtcaagaagtggctacatgattaggggatgtttaaatttgtatgacgacaaagttaattgcaacaagtagaaaacttgggtgctaacacaggataacttctgctctttttctttcctggatatagttctgttggggtataaagtattaggtatttgtattttttgctgtcaaaataatggacttaacttttagagtgttcacagctaggatctctgtatttgtttttcaactaacaactaattttaaatgtattgtatcttttattacctgttctcttagattgttttttgctagtaacccttactcagcttctgcctttggggcttggactaatattgcttgtatggaactacagtactgtgactaaacatggagctcaatgcagctactgcttacaactgcttaaactttgtagtttggacttcatttttttctgtaataacaacttattaaatctagttgtatgaagta

SEQ ID NO: 124738 - DNA, 5789 bp, Homo sapiens
  Payload ID: 4492
  Gene Symbol: CPEB3
  Gene Name: cytoplasmic polyadenylation element binding protein 3
  Uniprot ID: Q8NE35
  ENST ID: ENST00000614585
  CDS Start-End: 123-2219
acagttgtcaaagtgcttttgccagagcggtcacataatcaacctgaaagaagaaaataaatactgtatacttttaaattttatcgattcttaaaaactggacactcaaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggtaaacactaccctcccagtggcccaccaatgagtttcgctgatataatgtggaggaatcattttgcaggacgcatggggataaatttccatcatccaggaacagataatattatggcacttaacaatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtacggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagcag
